(12) United States Patent
Hicks et al.

(10) Patent No.: US 9,677,139 B2
(45) Date of Patent: Jun. 13, 2017

(54) GENETIC MARKERS INDICATIVE OF A CANCER PATIENT RESPONSE TO TRASTUZUMAB (HERCEPTIN)

(75) Inventors: James Hicks, Huntington, NY (US); Alexander Krasnitz, Huntington, NY (US)

(73) Assignee: COLD SPRING HARBOR LABORATORY, Cold Spring Harbor, NY (US)

( * ) Notice: Subject to any disclaimer, the term of this patent is extended or adjusted under 35 U.S.C. 154(b) by 0 days.

(21) Appl. No.: 13/491,359

(22) Filed: Jun. 7, 2012

(65) Prior Publication Data

US 2012/0328607 A1 Dec. 27, 2012
US 2016/0340735 A9 Nov. 24, 2016

Related U.S. Application Data

(63) Continuation-in-part of application No. PCT/US2010/059846, filed on Dec. 10, 2010.

(60) Provisional application No. 61/495,827, filed on Jun. 10, 2011, provisional application No. 61/285,933, filed on Dec. 11, 2009.

(51) Int. Cl.
*C12Q 1/68* (2006.01)
*A61K 39/395* (2006.01)
*A61K 31/337* (2006.01)
*A61K 39/00* (2006.01)

(52) U.S. Cl.
CPC .......... *C12Q 1/6886* (2013.01); *A61K 31/337* (2013.01); *A61K 39/39558* (2013.01); *A61K 2039/545* (2013.01); *C12Q 2600/106* (2013.01); *C12Q 2600/156* (2013.01)

(58) Field of Classification Search
None
See application file for complete search history.

(56) References Cited

U.S. PATENT DOCUMENTS

| | | | |
|---|---|---|---|
| 6,569,617 B1 | 5/2003 | Wigler et al. | |
| 7,531,307 B2 | 5/2009 | Wigler et al. | |
| 8,273,871 B2 | 9/2012 | Hannon et al. | |
| 2005/0032095 A1 | 2/2005 | Wigler et al. | |
| 2005/0266444 A1 | 12/2005 | Wigler et al. | |
| 2005/0287543 A1 | 12/2005 | Yu et al. | |
| 2006/0257895 A1* | 11/2006 | Pinkel et al. | 435/6 |
| 2007/0161008 A1 | 7/2007 | Morrison et al. | |
| 2007/0207481 A1 | 9/2007 | Wigler et al. | |
| 2009/0280493 A1 | 11/2009 | Wirtz | |
| 2010/0227768 A1 | 9/2010 | Wigler et al. | |
| 2012/0149593 A1 | 6/2012 | Hicks et al. | |
| 2013/0179999 A1 | 7/2013 | Hannon et al. | |

FOREIGN PATENT DOCUMENTS

WO 2008/154249 12/2008
WO WO 2012/054873 4/2012

OTHER PUBLICATIONS

National Library of Medicine, National Institutes of Health. Genetics Home Reference. Chromosome 5 (Bethesda, MD, USA), available via url: <ghr.nlm.nih.gov/chromosome/5#ideogram> printed on Apr. 7, 2014.*
National Library of Medicine, National Institutes of Health. NCBI Map viewer for chromosome 5 (Bethesda, MD, USA), available via url: <ncbi.nlm.nih.gov/mapview/maps.cgi?org=human &maps=ideogr,morbid,pheno&zoom=100&chr=5>, printed on Apr. 7, 2014.*
UCSC Genome Browser on Human Mar. 2006 (NCBI36/hg18) Assembly, available via url: <genome.ucsc.edu/cgi-bin/hgGateway?db=hg18>, printed on Apr. 7, 2014.*
National Center for Biotechnology Information, National Library of Medicine, OMIM Database for the ERBB2 gene (Bethesda, MD, USA), available via url: <omim.org/entry/164870>, p. 1, printed on Apr. 8, 2014.*
Baumbusch et al BMC Genomics. Aug. 8, 2008. 9: 379.*
Seidman et al J Clin Oncology. 2008. 26(10):1642-1649.*
Aug. 30, 2011 International Search Report, issued in connection with PCT International Application No. PCT/US2010/059846, of which the subject application claims benefit.
Jun. 12, 2012 International Preliminary Report on Patentability, issued in connection with PCT International Application No. PCT/US2010/059846, of which the subject application claims benefit.
Gullo et al., "Level of HER2/neu gene amplification as a predictive factor of response to trastuzumab-based therapy in patients with HER2-positive metastatic breast cancer" Ingest New Drugs, (2008) 27(2):179-183.
Moelans et al., "Absence of chromosome 12 polysomy in breast cancer: analysis by CEP17 chromogenic in situ hybridization and multiplex ligation-dependent probe amplification" Breast Cancer Res. Treat., (2009) 120:1-7.
Morrison et al., "Effects of ERBB2 amplicon size and genomic alterations of chromosomes 1, 3, and 10 on patient response to trastuzumab in metastatic breast cancer" Genes Chromosomes Cancer (2007) 46(4):397-405 (Abstract Only).

* cited by examiner

*Primary Examiner* — Carla Myers
(74) *Attorney, Agent, or Firm* — Gary J. Gershik; Cooper & Dunham LLP

(57) ABSTRACT

The invention relates to the fields of therapeutics and identifying candidates for therapy, in particular to a method of identifying candidates for trastuzumab (Herceptin®) therapy in a patient presenting with breast cancer based on the presence or absence of specific genetic markers in a tumor sample from said patient.

4 Claims, 24 Drawing Sheets

Genotyping Distribution in 9840/9342 vs an Early Stage Cohort

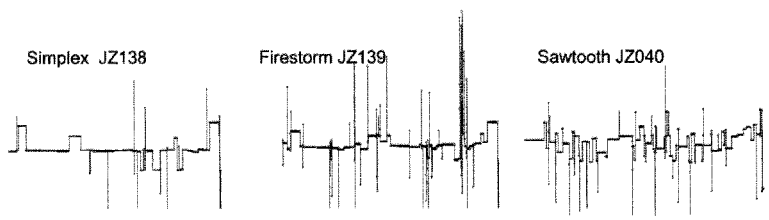

| Pseudo-diploid | Freq in 9840 | Freq in 9342 | Approx. freq. expect for unselect. set | Notes |
|---|---|---|---|---|
| Simplex w/Her2 amp | 2/162 (1.2%) | 0/54 | <1% | LumA-like |
| Simplex Her2 norm | 2/162 (1.2%) | 3/54 (5.7%) | 24% | LumA-like |
| Sawtooth w/Her2 amp | 1/162 (0.6%) | 0/54 | <1% | Basal-like/ LumB |
| Sawtooth Her2 norm | 1/162 (0.6%) | 1/54 (1.9%) | 4% | Basal-like/Her2 |
| Firestorm w/Her2 amp | 1/162 (0.6%) | 6/54 (11.4%) | 10% | Her2 |
| Firestorm Her2 norm | 1/162 (0.6%) | 4/54 (7.8%) | 10% | LumB-like |
| Aneuploid/Polyploid | | | | |
| Simplex w/Her2 amp | 2/162 (1.2%) | 0/54 | <1% | LumA/Her2 like |
| Simplex Her2 norm | 2/162 (1.2%) | 0/54 | <1%% | Normal-like |
| Sawtooth w/Her2 amp | 5/162 (3.1%) | 1/54 (1.9%) | 9% | Basal/Her2 |
| Sawtooth Her2 norm | 24/162 (14.8%) | 9/54 (16.7%) | 15% | Basal-like |
| Firestorm w/Her2 amp | 30/162 (18.5%) | 5/54 (9.3%) | 10% | Her2/LumB-like |
| Firestorm Her2 norm | 59/162 (36.4%) | 15/54 (27.8%) | 14% | LumB-like |
| Too complex to call | 8 | 9 | | |

Figure 5

GENETIC MARKERS INDICATIVE OF A CANCER PATIENT RESPONSE TO TRASTUZUMAB (HERCEPTIN)

This application is a continuation-in-part of PCT International Application No. PCT/US10/59846, filed Dec. 10, 2010, claiming priority of U.S. Provisional Application No. 61/285,933, filed Dec. 11, 2009; and also claims the benefit of U.S. Provisional Application No. 61/495,827, filed Jun. 10, 2011, the entire contents of each of which are hereby incorporated by reference in their entireties.

Throughout this application, various publications are referenced by full citation. The disclosures of these publications in their entireties are hereby incorporated by reference into this application to more fully describe the state of the art to which this invention pertains.

REFERENCE TO A SEQUENCE LISTING

This application incorporates-by-reference nucleotide and/or amino acid sequences which are present in the file named "170130_82936_A_Sequence_Listing_JJC.txt", which is 19,589 kilobytes in size, and which was created Jan. 17, 2017 in the IBM-PC machine format, having an operating system compatibility with MS-Windows, which is contained in the text file filed Jan. 30, 2017.

FIELD OF THE INVENTION

The invention relates to the fields of therapeutics and identifying candidates for therapy, in particular to a method of identifying candidates for trastuzumab (Herceptin®) therapy in a patient presenting with breast cancer based on the presence or absence of specific genetic markers in a tumor sample from said patient.

BACKGROUND OF THE INVENTION

As of 2007, an estimated 1.3 million new cases of invasive breast cancer were expected to occur among women and an estimated 465,000 breast cancer deaths in women were expected to occur. Breast cancer is the most frequently diagnosed cancer in women and it is the leading cause of cancer death among women worldwide. (ACS 2007 Stats).

Up to 25% of women who present with early breast cancer have developed tumors which overexpress human epidermal growth factor receptor 2 (Her2/neu), usually as a result of erbB2 gene amplification. (Owens M A at al. Clin. Breast Cancer 5 (2004)). These tumors are considered to be Her2+ and are characterized by aggressive growth and division, which can result in high recurrence rates after initial treatment and poor prognosis. (Slamon D J, Clark G M, Wong S G, Levin W J, Ullrich A, McGuire W L. Human breast cancer: correlation of relapse and survival with amplification of the Her2/neuoncogene. Science, 1987; 235: 177-182).

One method to test for Her2+ tumors is to use immunohistochemistry (IHC) to measure the levels of receptor on cancer cell surfaces. The test is scored on a scale of 0 to 3+, where a score of 0=negative, 1+=negative, 2+=borderline, or 3+=positive based on a reviewer's interpretation of staining intensity and completeness of membrane staining.

Additionally, Her2 gene amplification is detected using a fluorescent in situ hybridization (FISH) test that quantifies the number of gene copies in the cancer cell nucleus. A number of reports have verified its accuracy both in freshly frozen and paraffin-embedded tumor material (Mitchell, M. S., *Semin. Oncol,* 26:108 (1999))). FISH is generally performed using either single-color (HER-2/neu probe only) or dual-color hybridization (using HER-2/neu and control probes (e.g., chromosome 17 centromere probes simultaneously), with the latter method making it easier to distinguish true HER-2/neu amplification from chromosomal aneuploidy. FISH using entire cells (e.g., cultured cells, pulverized tissue, or imprint touch specimens from tumors) is considered straightforward, but the use of tissue sections complicates the quantitative nature of FISH due to nuclear truncation (i.e., due to the slicing of the tissues during their preparation for staining).

Chromogenic in situ hybridization (CISH) operates according to the same principles as FISH, except polynucleotide probes are labeled with a chromogen rather than a fluorophore. CISH does not require a costly fluorescent microscope and CISH signals do not decay over time.

Trastuzumab (Herceptin®) was developed as a targeted therapy to combat Her2 overexpression. Trastuzumab is a humanized monoclonal antibody directed against the extracellular domain of Her2 and is therefore specific for its target. Trastuzumab is approved for the adjuvant treatment of Her2-overexpressing node-positive or node-negative breast cancer. Trastuzumab in combination with paclitaxel is approved for the first-line treatment of Her2-overexpressing metastatic breast cancer. Trastuzumab as a single agent is approved for treatment of Her2-overexpressing breast cancer in patients who have received one or more chemotherapy regimens for metastatic disease. Trastuzumab has been shown to be effective across all of its approved uses (C. Jakisch, Her2-positive metastatic breast cancer: optimizing trastuzumab-based therapy, Oncologist 11 (2006) 34-41; Gonzalez-Angulo, G. N. Hortobagyi, F. J. Esteva, Adjuvant therapy with trastuzumab for Her2/neu-positive breast cancer, Oncologist 11 (2006) 857-867; C. A. Hudis, Trastuzumab-mechanism of action and use in clinical practice. N. Engl. J. Med. 357 (1) (Jul. 5, 2007) 39-51.).

Unfortunately, not all patients with Her2+ tumors are responsive to trastuzumab treatment. Trastuzumab monotherapies only lead to tumor regression in approximately 30% of patients. Complicating the issue further is the fact that administration of trastuzumab with anthracyclines and cyclophosphamide, while effective, leads to cardiac events in 28% of the patients. (T. M. Suter. N. Cook-Bruns, C. Barton, Cardiotoxicity associated with trastuzumab (Herceptin) therapy in the treatment of metastatic breast cancer, Breast 13 (3) (June 2004) 173-183). Additionally, a trastuzumab-containing treatment regimen is expensive, costing up to $100,000 per year. Thus, in an effort to reduce dangerous side effects and provide the most effective treatment, it is imperative to further refine the process by which trastuzumab is prescribed to try to better identify who will be sensitive to treatment.

Currently, because of the cost and risk associated with trastuzumab treatment, only subjects that have Her2+ tumors are administered the drug. Amongst these trastuzumab-treated Her2+ patients, up to 30-50% of patients will not positively respond to the treatment. Furthermore, it is currently thought that patients with Her2− tumors will not benefit from trastuzumab treatment. Nonetheless, despite the response rate in Her2+ patients, and the unknown effects of treatment in Her2− patients, trastuzumab treatment decisions are currently based on the detection of elevated Her2 levels. The discovery of additional markers could improve treatment decisions and identify Her2− subjects who could

SUMMARY OF THE INVENTION

In a first aspect, the invention relates to a process of producing information indicative of whether a human cell has a deletion at human chromosome region Chr18:309355-76106388 (marker D3), a deletion at human chromosome region Chr15:20444124-88087873 (marker D1), a deletion at human chromosome region Chr8:2780282-31010773 (marker D26), a deletion at human chromosome region Chr17:1612008-46199917 (marker D31), a deletion at human chromosome region Chr18:44824169-76106388 (marker D57), a deletion at human chromosome region Chr17:36157799-41605371 (marker D58), an amplification at human chromosome region Chr11:5755441-5766622 (marker A1), an amplification at human chromosome region Chr11: 5755441-5756473 (marker A73) or an amplification at human chromosome region 4q169.81-q185.239 (marker B), comprising determining by apparatus a copy number for marker D3, marker D11, marker D26, marker D31, marker D57, marker D58, marker A1, marker A73, or marker B, thereby producing information indicative of whether human cell has a deletion at marker D3, a deletion at marker D11, a deletion at marker D26, a deletion at marker D31, a deletion at marker D57, a deletion at marker D58, an amplification at marker A1, an amplification at marker A73, or an amplification at marker B.

In a second aspect, the invention relates to a process for identifying a human subject as a candidate for trastuzumab therapy comprising determining by apparatus a copy number of human chromosome region Chr18:309355-76106388 (marker D3), human chromosome region Chr15:20444124-88087873 (marker D11), human chromosome region Chr8:2780282-31010773 (marker D26), human chromosome region Chr17:1612008-46199917 (marker D31), human chromosome region Chr18:44824169-76106388 (marker D57), human chromosome region Chr17:36157799-41605371 (marker D58), human chromosome region Chr11:5755441-5766622 (marker A1), human chromosome region Chr11:5755441-5756473 (marker A73) or human chromosome region 4q169.81-q185.239 (marker B) in a cancer cell of the subject, and identifying the subject as a candidate for trastuzumab therapy if the copy number data of step a) is indicative of a deletion at marker D3, a deletion at marker D11, a deletion at marker D26, a deletion at marker D31, a deletion at marker D57, a deletion at marker D58, an amplification at marker A1, an amplification at marker A73, or an amplification at marker B.

In a third aspect, the invention relates to a method of treating a human subject afflicted with cancer comprising a) obtaining information indicative of whether the human subject is a candidate for trastuzumab therapy, the information based on a copy number of human chromosome region Chr18:309355-76106388 (marker D3), human chromosome region Chr15:20444124-88087873 (marker D11), human chromosome region Chr8:2780282-31010773 (marker D26), human chromosome region Chr17:1612008-46199917 (marker D31), human chromosome region Chr18:44824169-76106388 (marker D57), human chromosome region Chr17:36157799-41605371 (marker D58), human chromosome region Chr1:5755441-5766622 (marker A1), human chromosome region Chr11:5755441-5756473 (marker A73) or human chromosome region 4q169.81-q185.239 (marker B), wherein the subject is a candidate for trastuzumab therapy it the copy number data is indicative of a deletion at marker D3, a deletion at marker D11, a deletion at marker D26, a deletion at marker D31, a deletion at marker D57, a deletion at marker D58, an amplification at marker A1, an amplification at marker A73, or an amplification at marker B; and b) if the information indicates that the human subject is a candidate for trastuzumab therapy, then administering to the human subject an amount of trastuzumab effective to treat the human subject afflicted with cancer.

In a fourth aspect, the invention relates to a kit for identifying a subject's sensitivity to trastuzumab therapy, said kit comprising one or more nucleic acid probes each of which selectively bind to a target polynucleotide sequence of the chromosome region comprising one of human chromosome region Chr18:309355-76106388 (marker D3), human chromosome region Chr15:20444124-88087873 (marker D11), human chromosome region Chr8:2780282-31010773 (marker D26), human chromosome region Chr17: 1612008-46199917 (marker D31), human chromosome region Chr18:44824169-76106388 (marker D57), human chromosome region Chr17:36157799-41605371 (marker D58), human chromosome region Chr11:5755441-5766622 (marker A1), human chromosome region Chr11:5755441-5756473 (marker A73) or human chromosome region 4q169.81-q185.239 (marker B) under conditions in which the probe forms a stable hybridization complex with the target polynucleotide sequence.

In a fifth aspect, the invention relates to a method of identifying a genomic marker comprising: a) obtaining a set of genomic copy number profiles; b) deriving from the set of genomic copy number profiles a set of N copy number events $A_j$, wherein j=1, . . . , N and wherein each copy number event is associated with a specific interval of the genome and a real number $U_j$, wherein $0 \leq U_j \leq 1$; c) setting $U_j$ to 1; d) determining for each copy number event $A_j$ and an interval I an explanation value $E_j(I)$, wherein $E_j(I)=U_j L(I)/L(A_j)$ if I is contained in $A_j$ and $E_j(I)=0$ if I is not contained in Aj, and wherein L(I) is the length of interval I and $L(A_1)$ is the length of copy number event $A_j$; e) summing the values determined in step (d) for interval I to provide an explanation of the set of copy number events, E(I); f) determining an optimal explanation value S of the set of copy number events and a corresponding optimal explaining interval C, wherein S=max$_I$E(I) and wherein C=argmax$_I$E (I); g) updating $U_j$ by subtracting the value of C determined in step (f) for all j=1, . . . , N; h) repeating step (d) through step (g) at least one times and i) selecting an optimal explaining interval whose optimal explanation value is statistically significant, thereby identifying an optimal explaining interval as a genomic marker.

In a sixth aspect, the invention relates to a process of producing information indicative of whether a human cell has a deletion at chromosome region 17q35.42-q56.76, a deletion at human chromosome region 17q32.010-q32.34.215 or an amplification at human chromosome region 4q169.81-q185.239, comprising determining by apparatus a copy number for 17q35.42-q56.76, 17q32.010-q32.34.215 or 4q169.81-q185.239, thereby producing information indicative of whether human cell has a deletion at 17q35.42-q56.76, a deletion at human 17q32.010-q32.34.215 or an amplification at 4q169.81-q185.239.

In a seventh aspect, the invention relates to a process for identifying a human subject as a candidate for trastuzumab therapy comprising determining by apparatus a copy number of human chromosome region 17q35.42-q56.76, human chromosome region 17q32.010-q32.34.215 or human chromosome region 4q169.81-q185.239 in a cancer cell of the subject; and identifying the subject as a candidate for trastuzumab therapy if the copy number data is indicative of a deletion at 17q35.42-q56.76, a deletion at 17q32.010-q32.34.215 or an amplification at 4q169.81-q185.239.

In an eighth aspect, the invention relates to a method of treating a human subject afflicted with cancer comprising obtaining information indicative of whether the human subject is a candidate for trastuzumab therapy, the information based on a copy number of human chromosome region 17q35.42-q56.76, human chromosome region 17q32.010-q32.34.215 or human chromosome region 4q169.81-q185.239, wherein the subject is a candidate for trastuzumab therapy if the copy number data is indicative of a deletion at 17q35.42-q56.76, a deletion at 17q32.010-q32.34.215 or an amplification at 4q169.81-q185.239; and if the information indicates that the human subject is a candidate for trastuzumab therapy, then administering to the human subject an amount of trastuzumab effective to treat the human subject afflicted with cancer.

In a ninth aspect, the invention relates to a kit for identifying a subject's sensitivity to trastuzumab therapy, said kit comprising one or more nucleic acid probes each of which selectively bind to a target polynucleotide sequence of the chromosome region comprising one of human chromosome region 17q35.42-q56.76, human chromosome region 17q32.010-q32.34.215 or human chromosome region 4q169.81-q185.239 under conditions in which the probe forms a stable hybridization complex with the target polynucleotide sequence.

BRIEF DESCRIPTION OF THE FIGURES

FIG. 1. Comparison of aCGH measures of Her2 copy number with Her2 FISH and mRNA expression.

FIG. 3. Plots of trastuzumab response (treated vs. untreated) plotted as overall survival (y axis) over time in months (x axis) for various combinations of markers demonstrating that amplifications or deletions at particular markers are associated with an increased sensitivity to trastuzumab.

FIG. 68. Deletions of BRCA1 identify response to Trastuzumab among cases NOT amplified for ERBB2. Survival (y axis) measured over months (x axis).

DETAILED DESCRIPTION OF THE INVENTION

Figure 1A:
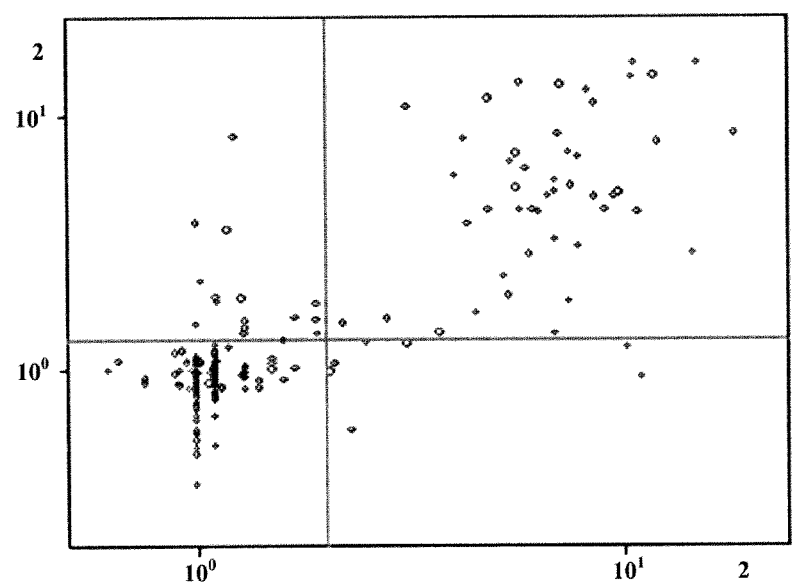
FIG. 1A. Her2 CGH values (y axis) plotted against Her2 FISH values (x axis). Threshold values (gray lines) for positivity are 1.3 for CGH and 2.0 for FISH.
Figure 1B:
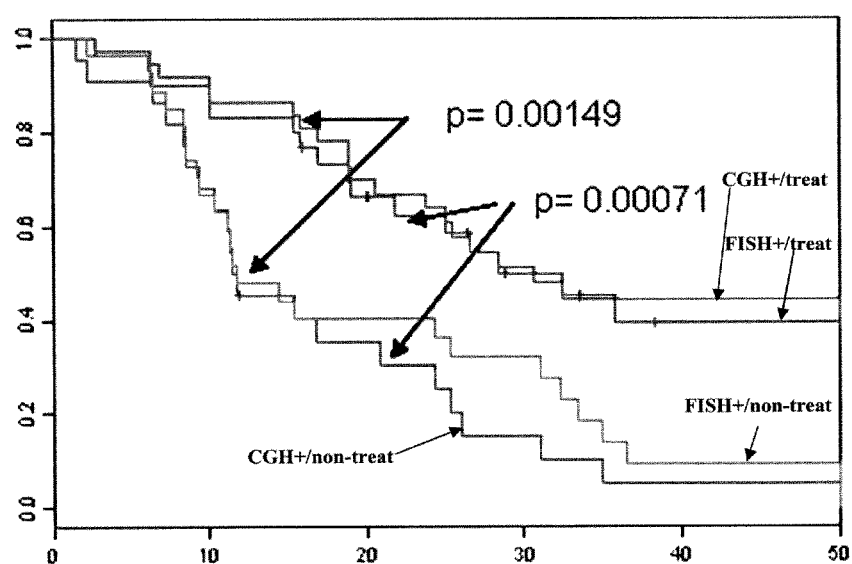
FIG. 1B. Plot of trastuzumab response measured as overall survival (treated vs. untreated) (y axis) over time in months (x axis) for patients assayed as positive by FISH or by CGH.
Figure 1C:
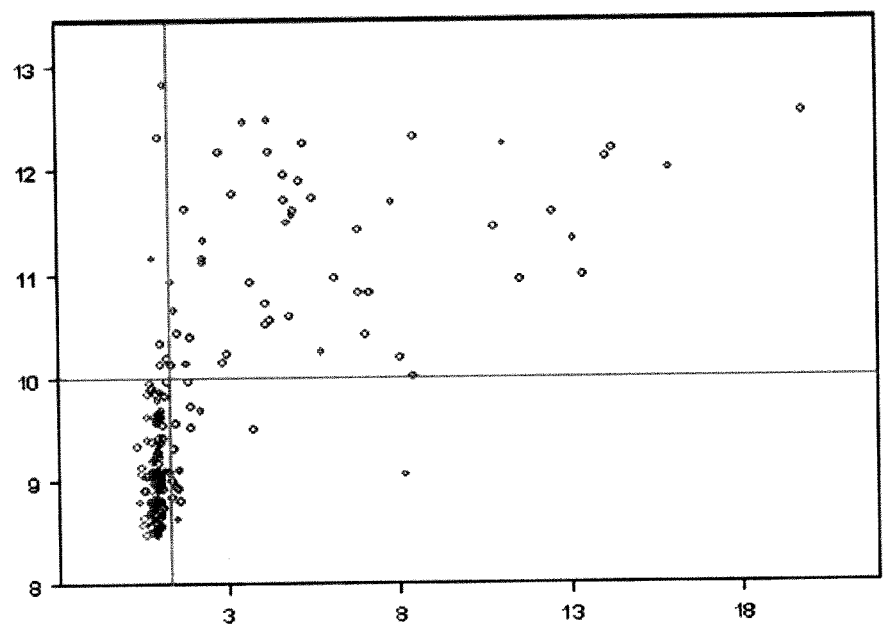
FIG. 1C. Scatterplot of Her2 mRNA expression (y axis) compared to FISH copy number (x axis). Threshold value for overexpression set at 10 (gray line).
Figure 1D:
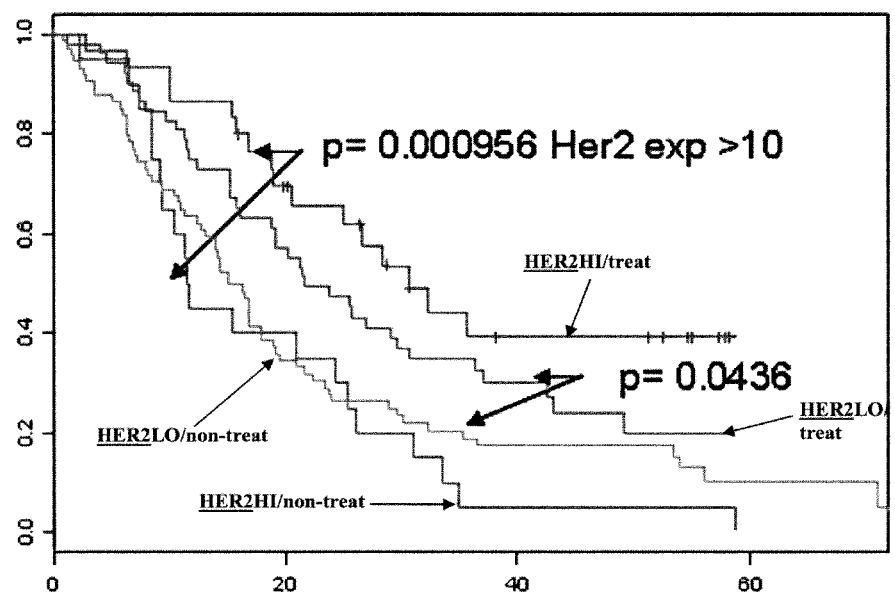
FIG. 1D. Plot of trastuzumab response measured as overall survival (treated vs. untreated) (y axis) over time in months (x axis) for patients with Her2 expression >10 ("HER2HI") compared to patients with expression <10 ("HER2LO").

In order to facilitate the understanding of the invention described in this patent application, the meaning of some terms and expressions in the context of the invention are explained below: As used herein, the term "amplification" or "amplified" when each refers to a genomic region indicates that such genomic region is present in the genomic DNA at a higher copy number than the mean copy number of the remainder of the genome.

As used herein, the term "candidate for trastuzumab therapy" refers to a human that is suspected of having cancer that may be evaluated for suitability for trastuzumab treatment. Examples of candidate subjects include, but are not limited to, human women suspected of having breast cancer and human men suspected of having breast cancer.

The term "sample" as used herein, relates to any sample which can be obtained from the patient. The present method can be applied to any type of biological sample from a patient, such as a biopsy sample, tissue, cell or fluid (serum, saliva, semen, sputum, cerebral spinal fluid (CSF), tears, mucus, sweat, milk, brain extracts and the like). In a particular embodiment, said sample is a tumour tissue sample or portion thereof. In a more particular embodiment, said tumor tissue sample is a breast tumor tissue sample from a patient suffering from breast cancer. Said sample can be obtained by conventional methods, e.g., biopsy, by using methods well known to those of ordinary skill in the related medical arts. Methods for obtaining the sample from the biopsy include gross apportioning of a mass, or microdissection or other art-known cell-separation methods. Tumour cells can additionally be obtained from fine needle aspiration cytology. In order to simplify conservation and handling of the samples, these can be formalin-fixed and paraffin-embedded or first frozen and then embedded in a cryosolidifiable medium, such as OCT-Compound, through immersion in a highly cryogenic medium that allows for rapid freeze. The samples may be obtained from subjects previously diagnosed with breast cancer (patients), or from subjects who have not been previously diagnosed with breast cancer, or from patients diagnosed with breast cancer who are undergoing treatment, or from subjects diagnosed with breast cancer who have been previously treated.

As used herein, the term "copy number" as used in reference to specific nucleic acid sequences (e.g., Her2/neu, marker D3, marker D11, marker D26, marker D31, marker D57, marker D58, marker A1, marker B and control) refers to the actual number of these sequences per single cell. Copy number may be reported for one single cell, or reported as the average number in a group of cells (e.g., tissue sample). When comparing the "copy number" of cells (e.g., experimental and control cells) one need not determine the exact copy number of the cell, but instead need only obtain an approximation that allows one to determine whether a given cell contains more or less of the nucleic acid sequence as compared to another cell. Thus, any method capable of reliably directly or indirectly determining amounts of nucleic acid may be used as a measure of copy number even if the actual copy number is not determined. In an embodiment, copy number can be represented as the ratio of hybridization signal at any locus in the genome comparing a tumor DNA sample to a DNA sample from a standard diploid reference.

As used herein, the term "Her2" refers to a nucleic acid sequence encoding the Human epidermal growth factor receptor 2 (Her2) protein, and includes both the wild-type sequence and naturally occurring variations, truncations, and mutations. Her2 is also known as "HER2," "Her-2," "Her-2/neu," "neu," "ErbB-2," and "ERBB2," all of which terms are encompassed herein in "Her2."

As used herein, the term "apparatus" refers to any methods, assays or equipment used to determine copy number of one or more genomic regions of a chromosome. Methods may include polymerase chain reaction (PCR), quantitative PCR, Southern Blotting, in situ hybridization techniques (ISH) (e.g., fluorescent in situ hybridization (FISH) or chromogenic in situ hybridization (CISH)), comparative genomic hybridization (CGH), array comparative genomic hybridization (aCGH), representational oligonucleotide microarray analysis (ROMA) and any other techniques used to determine copy number readily available and known to those of skill in the art. Equipment may include DIC microscope, fluorescent microscope, microarrays, slide scanners, computer software, computer algorithms and any other equipment used to determine copy number of a genomic region.

As used herein, the term "indicative of the subject's sensitivity to trastuzumab therapy", refers to a subject that is either Her2+, has a deletion at marker D3, a deletion at marker D11, a deletion at marker D26, a deletion at marker D31, a deletion at marker D57, a deletion at marker D58, an amplification at marker A1, an amplification at marker A73, an amplification at marker B, a deletion at marker D1, a deletion at marker D2, or has any combination or permutation of one, two three, four, five, six, seven, eight, nine, ten, eleven or twelve of the events.

As used herein, the term "amplification" when used in reference to copy number refers to the condition in which the copy number of a nucleic acid sequence (e.g., Her2) is greater than the copy number of a control sequence (e.g., chromosome 17). In other words, amplification indicates that the ratio of a particular nucleic acid sequence (e.g., Her2) is greater than 1:1 when compared to a control sequence (e.g., 1.1:1, 1.2:1, or 1.3:1).

As used herein, the term "deletion" when used in reference to copy number refers to the condition in which the copy number of a nucleic acid sequence (e.g., Her2) is less than the copy number of a control sequence (e.g., chromosome 17). In other words, amplification indicates that the ratio of a particular nucleic acid sequence (e.g., Her2) is less than 1:1 when compared to a control sequence (e.g., 0.25:1, 0.50:1, or 0.85:1).

As used herein, the term 'nucleic acid' refers to any nucleic acid containing molecule including, but not limited to DNA or RNA. The term encompasses sequences that include any of the known base analogs of DNA and RNA including, but not limited to, 4-acetylcytosine, 8-hydroxy-N-6-methyladenosine, aziridinylcytosine, pseudoisocytosine, 5-(carboxyhydroxylmethyl) uracil, 5-fluorouracil, 5-bromouracil, 5-carboxymethylaminomethyl-2-thiouracil, 5-carboxymethylaminomethyluracil, dihydrouracil, inosine. N6-isopentenyladenine, 1-methyladenine, 1-methylpseudouracil, 1-methylguanine, 1-methylinosine, 2,2-dimethylguanine, 2-methyladenine, 2-methylguanine, 3-methylcytosine, 5-methylcytosine. N6-methyladenine, 7-methylguanine, 5-methylaminomethyluracil, 5-methoxyaminomethyl-2-thiouracil, beta-Dmannosylqueosine, 5'-methoxycarbonylmethyluracil, 5-methoxyuracil, 2-methylthio-N-6-isopentenyladenine, uracil-5-oxyacetic acid methylester, uracil-5-oxyacetic acid, oxybutoxosine, pseudouracil, queosine, 2-thiocytosine, 5-methyl-2-thiouracil, 2-thiouracil, 4-thiouracil, 5-methyluracil, N-uracil-5- oxyacetic acid methylester, uracil-5-oxyacetic acid, pseudouracil, queosine, 2-thiocytosine, and 2,6-diaminopurine.

As used herein, the term "hybridization" is used in reference to the pairing of complementary nucleic acids. Hybridization and the strength of hybridization (i.e., the strength of the association between the nucleic acids) is impacted by such factors as the degree of complementary between the nucleic acids, stringency of the conditions involved, the melting temperature of the formed hybrid, and the G:C ratio within the nucleic acids.

As used herein, the term "probe" refers to an oligonucleotide (i.e., a sequence of nucleotides), whether occurring naturally as in a purified restriction digest or produced synthetically, recombinantly or by amplification (e.g. PCR), which is capable of hybridizing to another oligonucleotide of interest. Probes useful in the present invention may be single-stranded or double-stranded. Probes are useful in the detection, identification and isolation of particular gene sequences (e.g., Her2, marker A1, marker A2 or marker B). It is contemplated that any probe used in the present invention may be labeled with any "reporter molecule," so that is detectable in any detection system, including, but not limited to enzyme (e.g., ELISA, as well as enzyme-based immunohistochemical assays), fluorescent (e.g., FISH), radioactive, mass spectroscopy, and luminescent systems. It is not intended that the present invention be limited to any particular detection system or label.

As used herein, the term "label" refers to any molecule which may be detected. For example, labels include, but are not limited to, 32P, 14C, 125I, 3H, 35S, biotin, digoxigenin, avidin, fluorescent or enzymatic molecules.

The reference genome referred to as freeze HG 18 is the March 2006 human reference sequence (NCBI Build 36.1) which was produced by the International Human Genome Sequencing Consortium (Nature. (2001) February 15; 409 (6822):860-921; Kuhn et al., "The UCSC Genome Browser database: update 2007." Nucleic Acids Res. (2007) January; 35 (Database issue):D668-D673; Fujita at al., "The UCSC Genome Browser database: update 2011." Nucleic Acids Res. (2011) 39 (suppl 1): D876-D882.) The HG18 reference genome data is publicly available at: genome.ucsc.edu/cgi-bin/hgGateway?db=hg1 8. As used herein, "as defined by the freeze HG18 reference genome", refers to the numbering of chromosomal positions set forth based on the human reference genome HG18, NCBI Build 36.1.

A process is provided for producing information indicative of whether a human cell has a deletion at human chromosome region Chr18:309355-76106388 (marker D3), a deletion at human chromosome region Chr15:20444124-88087873 (marker D11), a deletion at human chromosome region Chr8:2780282-31010773 (marker D26), a deletion at human chromosome region Chr17:1612008-46199917 (marker D31), a deletion at human chromosome region Chr18:44824169-76106388 (marker D57), a deletion at human chromosome region Chr17:36157799-41605371 (marker D58), an amplification at human chromosome region Chr11:5755441-5766622 (marker A1), an amplification at human chromosome region Chr11:5755441-5756473 (marker A73) or an amplification at human chromosome region 4q169.81-q185.239 (marker B), comprising determining by apparatus a copy number for marker D3, marker D11, marker D26, marker D31, marker D57, marker D58, marker A1, marker A73, or marker B, thereby producing information indicative of whether human cell has a deletion at marker D3, a deletion at marker D11, a deletion at marker D26, a deletion at marker D31, a deletion at marker D57, a deletion at marker D58, an amplification at marker A1, an amplification at marker A73, or an amplification at marker B.

In an embodiment, the process comprises determining by apparatus a copy number for marker D3, marker D11, marker D26, marker D31, marker D57, marker D58, marker A1, or marker A73.

In an embodiment, the process comprises determining the copy number for two of the markers D3, D11, D26, D31, D57, D58, A1, A73, or B, thereby producing information indicative of whether the human cell has two of the markers D3, D11, D26, D31, D57, D58, A1, A73, or B. The copy number can be determined for any combination or permutation of two of the markers. In an embodiment, the two markers are D3 and D57. In another embodiment, the two markers are D31 and D58.

In an embodiment, the process comprises determining the copy number for three of the markers D3, D11, D26, D31, D57, D58, A1, A73, or B, thereby producing information indicative of whether the human cell has three of the markers D3, D11, D26, D31, D57, D58, A1, A73, or B. The copy number can be determined for any combination or permutation of three of the markers.

In an embodiment, the process comprises determining the copy number for four of the markers D3, D11, D26, D31, D57, D58, A1, A73, or B, thereby producing information indicative of whether the human cell has four of the markers D3, D11, D26, D31, D57, D58, A1, A73, or B. The copy number can be determined for any combination or permutation of four of the markers.

In an embodiment, the process comprises determining the copy number for five of the markers D3, D11, D26, D31, D57, D58, A1, A73, or B, thereby producing information indicative of whether the human cell has five of the markers D3, D11, D26, D31, D57, D58, A1, A73, or B. The copy number can be determined for any combination or permutation of five of the markers.

In an embodiment, the process comprises determining the copy number for six of the markers D3, D11, D26, D31, D57, D58, A1, A73, or B, thereby producing information indicative of whether the human cell has six of the markers D3, D11, D26, D31, D57, D58, A1, A73, or B. The copy number can be determined for any combination or permutation of six of the markers.

In an embodiment, the process comprises determining the copy number for seven of the markers D3, D11, D26, D31, D57, D58, A1, A73, or B, thereby producing information indicative of whether the human cell has seven of the markers D3, D11, D26, D31, D57, D58, A1, A73, or B. The copy number can be determined for any combination or permutation of seven of the markers.

In an embodiment, the process comprises determining the copy number for eight of the markers D3, D11, D26, D31, D57, D58, A1, A73, or B, thereby producing information indicative of whether the human cell has eight of the markers D3, D11, D26, D31, D57, D58, A1, A73, or B. The copy number can be determined for any combination or permutation of eight of the markers.

In an embodiment, the process comprises determining the copy number for nine of the markers D3, D11, D26, D31, D57, D58, A1, A73, and B, thereby producing information indicative of whether the human cell has nine of the markers D3, D11, D26, D31, D57, D58, A1, A73, and B.

In an embodiment, the process further comprises determining a copy number for at least one additional marker selected from the group consisting of: a deletion at human chromosome region 17q35.42-q56.76 (marker D1) and a deletion at human chromosome region 17q32.010-34.215 (marker D2).

A process is provided for identifying a human subject as a candidate for trastuzumab therapy comprising:

a) determining by apparatus a copy number of human chromosome region Chr18:309355-76106388 (marker D3), human chromosome region Chr15:20444124-88087873 (marker D11), human chromosome region Chr8:2780282-31010773 (marker D26), human chromosome region Chr17:1612008-46199917 (marker D31), human chromosome region Chr18:44824169-76106388 (marker D57), human chromosome region Chr17:36157799-41605371 (marker D58), human chromosome region Chr11:5755441-5766622 (marker A1), human chromosome region Chr11:5755441-5756473 (marker A73) or human chromosome region 4q169.81-q185.239 (marker B) in a cancer cell of the subject; and b) identifying the subject as a candidate for trastuzumab therapy if the copy number data of step a) is indicative of a deletion at marker D3, a deletion at marker D11, a deletion at marker D26, a deletion at marker D31, a deletion at marker D57, a deletion at marker D58, an amplification at marker A1, an amplification at marker A73, or an amplification at marker B.

An embodiment of the process comprises determining by apparatus the copy number of marker D3, marker D11, marker D26, marker D31, marker D57, marker D58, marker A1, or marker A73.

An embodiment of the process comprises determining by apparatus the copy number of two of the markers D3, D11, D26, D31, D57, D58, A1, A73, or B, and identifying the subject as a candidate for trastuzumab therapy if the copy number data of the two markers is indicative of the subject's sensitivity to trastuzumab therapy. The copy number can be determined for any combination or permutation of two of the markers. In an embodiment, the two markers are D3 and D57. In another embodiment, the two markers are D31 and D58.

An embodiment of the process comprises determining by apparatus the copy number of three of the markers three of the markers D3, D11, D26, D31, D57, D58, A1, A73, or B, and identifying the subject as a candidate for trastuzumab therapy if the copy number data of the three markers is indicative of the subject's sensitivity to trastuzumab therapy. The copy number can be determined for any combination or permutation of three of the markers.

An embodiment of the process comprises determining by apparatus the copy number of four of the markers D3, D11, D26, D31, D57, D58, A1, A73, or B, and identifying the subject as a candidate for trastuzumab therapy if the copy number data of the four markers is indicative of the subject's sensitivity to trastuzumab therapy. The copy number can be determined for any combination or permutation of four markers.

An embodiment of the process comprises determining by apparatus the copy number of five of the markers D3, D11, D26, D31, D57, D58, A1, A73, or B, and identifying the subject as a candidate for trastuzumab therapy if the copy number data of the five markers is indicative of the subject's sensitivity to trastuzumab therapy. The copy number can be determined for any combination or permutation of five markers.

An embodiment of the process comprises determining by apparatus the copy number of six of the markers D3, D11, D26, D31, D57, D58, A1, A73, or B, and identifying the subject as a candidate for trastuzumab therapy if the copy number data of the six markers is indicative of the subject's sensitivity to trastuzumab therapy. The copy number can be determined for any combination or permutation of six markers.

An embodiment of the process comprises determining by apparatus the copy number of seven of the markers D3, D11, D26, D31, D57, D58, A1, A73, or B, and identifying the subject as a candidate for trastuzumab therapy if the copy number data of the seven markers is indicative of the subject's sensitivity to trastuzumab therapy. The copy number can be determined for any combination or permutation of seven markers.

An embodiment of the process comprises determining by apparatus the copy number of eight of the markers D3, D11, D26, D31, D57, D58, A1, A73, or B, and identifying the subject as a candidate for trastuzumab therapy if the copy number data of the eight markers is indicative of the subject's sensitivity to trastuzumab therapy. The copy number can be determined for any combination or permutation of eight markers.

An embodiment of the process comprises determining by apparatus the copy number of all nine of the markers D3, D11, D26, D31, D57, D58, A1, A73, or B, and identifying the subject as a candidate for trastuzumab therapy if the copy number data of the nine markers is indicative of the subject's sensitivity to trastuzumab therapy.

An embodiment of the process further comprises determining by apparatus a copy number of one or both of human chromosome region 17q35.42-q56.76 (marker D1) and human chromosome region 17q32.010-34.215 (marker D2), wherein a deletion at marker D1 is indicative of the subject's sensitivity to trastuzumab therapy, and wherein a deletion at marker D2 is indicative of the subject's sensitivity to trastuzumab therapy, and identifying the subject as a candidate for trastuzumab therapy is the copy number data of the markers is indicative of the subject's sensitivity to trastuzumab therapy.

If the copy numbers of the markers are not determined simultaneously, then the copy number of each marker can be determined in any order.

In an embodiment of the process, the human subject has cancer and is Her 2−.

In an embodiment of the process, the human subject has cancer and is Her 2+.

In an embodiment of the process, the apparatus is a hybridization based assay.

In an embodiment of the process, the detecting step of the method of the invention comprises contacting the nucleic acid sample with one or more nucleic acid probes each of which selectively binds to a target polynucleotide sequence on the chromosome region at marker D3, marker D11, marker D26, marker D31, marker D57, marker D58, marker A1, marker A73, or marker B, under conditions in which the probe forms a stable hybridization complex with the target polynucleotide sequence; and detecting the hybridization complex. In a particular embodiment, the nucleic acid probes used in the method of the present invention are labeled with a fluorophore. In a particular embodiment, the step of detecting the hybridization complex comprises determining the copy number of the target polynucleotide sequence, thereby determining a deletion at marker D3, a deletion at marker D11, a deletion at marker D26, a deletion at marker D31, a deletion at marker D57, a deletion at marker D58, an amplification at marker A1, and amplification at marker A73, or an amplification at marker B.

A process is provided of producing information indicative of whether a human cell has a deletion at chromosome region 17q35.42-q56.76, a deletion at human chromosome region 17q32.010-q32.34.215 or an amplification at human chromosome region 4q169.81-q185.239, comprising determining by apparatus a copy number for 17q35.42-q56.76, 17q32.010-q32.34.215 or 4q169.81-q185.239, thereby producing information indicative of whether human cell has a deletion at 17q35.42-q56.76, a deletion at human 17q32.010-q32.34.215 or an amplification at 4q169.81-q185.239.

In an embodiment, the instant process comprises determining the copy number for two of 17q35.42-q56.76, 17q32.010-q32.34.215 or 4q169.81-q185.239, thereby producing information indicative of whether the human cell has two of the 17q35.42-q56.76, 17q32.010-q32.34.215 or 4q169.81-q185.239.

In an embodiment, the instant process comprises determining the copy number for all three of 17q35.42-q56.76, 17q32.010-q32.34.215 and B, thereby producing information indicative of whether the human cell has all three of 17q35.42-q56.76, 17q32.010-q32.34.215 and 4q169.81-q185.239.

A process is provided for identifying a human subject as a candidate for trastuzumab therapy comprising:
  determining by apparatus a copy number of human chromosome region 17q35.42-q56.76, human chromosome region 17q32.010-q32.34.215 or human chromosome region 4q169.81-q185.239 in a cancer cell of the subject; and
  identifying the subject as a candidate for trastuzumab therapy if the copy number data of step a) is indicative of a deletion at 17q35.42-q56.76, a deletion at 17q32.010-q32.34.215 or an amplification at 4q169.81-q185.239.

An embodiment of the process comprises determining by apparatus the copy number of two of 17q35.42-q56.76, 17q32.010-q32.34.215 or 4q169.81-q185.239, and identifying the subject as a candidate for trastuzumab therapy if the copy number data of the two markers is indicative of the subject's sensitivity to trastuzumab therapy. The copy number can be determined for any combination or permutation of two of the three markers, including but not limited to 17q35.42-q56.76/17q32.010-q32.34.215, 17q35.42-q56.76/4q169.81-q185.239 or 17q32.010-q32.34.215/4q169.81-q185.239.

In another embodiment, the process comprises determining by apparatus the copy number of all three of 17q35.42-q56.76, 17q32.010-q32.34.215 or 4q169.81-q185.239, and identifying the subject as a candidate for trastuzumab therapy if the copy number data of the three markers is indicative of the subject's sensitivity to trastuzumab therapy.

If the copy numbers of the markers are not determined simultaneously, then the copy number of each marker can be determined in any order.

In an embodiment of the process, the human subject has cancer and is Her 2−.

In an embodiment of the process, the human subject has cancer and is Her 2+.

In an embodiment of the process, the apparatus is a hybridization-based assay.

In an embodiment of the process, the detecting step of the method of the invention comprises contacting the nucleic acid sample with one or more nucleic acid probes each of which selectively binds to a target polynucleotide sequence on the chromosome region at 17q35.42-q56.76, 17q32.010-q32.34.215 or 4q169.81-q185.239, under conditions in which the probe forms a stable hybridization complex with the target polynucleotide sequence; and detecting the hybridization complex. In a particular embodiment, the nucleic acid probes used in the method of the present invention are labeled with a fluorophore. In a particular embodiment, the step of detecting the hybridization complex comprises determining the copy number of the target polynucleotide sequence, thereby determining a deletion of 17q35.42-q56.76, a deletion of marker 17q32.010-q32.34.215 or an amplification of 4q169.81-q185.239.

In an embodiment, said apparatus is selected from the group consisting of Southern blot, LOH (loss of heterozygosity), PCR, in situ hybridization (ISH) fluorescence ISH (FISH) and comparative genomic hybridization (CGH). In another embodiment, the apparatus is a comparative genomic hybridization apparatus.

In an embodiment, once the sample has been obtained and the total DNA has been extracted, genome-wide analysis of DNA copy number changes by comparative genomic hybridization (CGH) is carried out. In general, for a typical CGH measurement, total genomic DNA is isolated from test and reference cell populations, differentially labeled and hybridized to a representation of the genome that allows the binding of sequences at different genomic locations to be distinguished. Methods describing representations of genomes are described in U.S. Pat. No. 7,531,307 B2, issued May 12, 2009, Use of representations for DNA genetic analysis, the disclosure of which is incorporated by reference. Hybridization reactions can be performed under conditions of different stringency. The stringency of a hybridization reaction includes the difficulty with which any two nucleic acid molecules will hybridize to one another. For any hybridization, stringency can be varied by manipulation of three factors: temperature, salt concentration, and formamide concentration. High temperature and low salt increases stringency. Formamide decreases melting point of DNA, thus lowering the temperature at which a hybrid between two nucleic acid molecules forms. Preferably, each hybridizing polynucleotide hybridizes to its corresponding polynucleotide under reduced stringency conditions, more preferably stringent conditions, and most preferably highly stringent conditions.

The amount of specimen DNA is frequently a constraint on CGH measurements. Typical array CGH procedures use 300 ng to 3 ug of specimen DNA in the labeling reaction, equivalent to approximately 50,000 to 500,000 mammalian cells. Usually, random primer labeling protocols are employed, which also amplifies the DNA, so that several micrograms are used in the hybridization.

Array CGH has been implemented using a wide variety of techniques. On example of a genome-wide method is described in WO/2008/016374, published Feb. 7, 2008, Methods For Assessing Probabilistic Measures Of Clinical Outcome Using Genomic Profiling, the disclosure of which is incorporated herein by reference. In an embodiment, array CGH is carried out using arrays from large-insert genomic clones such as bacterial artificial chromosomes (BACs). The general principles and conditions for detection of nucleic acids, such as using array CGH (comparative genomic hybridization (CGH) to BAC microarrays), are well known for the skilled person in the art. This technique allows scanning the entire genome for DNA copy number changes therefore allowing quantitative detection of DNA copy number variation in tumor genomes with high resolution (Pinkel D, et al. High resolution analysis of DNA copy number variation using comparative genomic hybridization to microarrays. *Nat Genet* 1998; 20(2):207-11; Hodgson G, et al. Genome scanning with array CGH delineates regional alterations in mouse islet carcinomas. *Nat Genet* 2001;

29(4):459-64; and Solinas-Toldo S. et al. Matrix-based comparative genomic hybridization: biochips to screen for genomic imbalances. *Genes Chromosomes Cancer.* 1997 December; 20(4):399-407 are herein incorporated by reference).

The major technical challenge of array CGH is generating hybridization signals that are sufficiently intense and specific so that copy number changes can be detected. The signal intensity on an array element is affected by a number of factors including the base composition, the proportion of repetitive sequence content, and the amount of DNA in the array element available for hybridization.

Array elements made from genomic BAC clones typically provide more intense signals than elements employing shorter sequences such as cDNAs, PCR products, and oligonucleotides. The higher signals form the more complex array elements result in better measurement precision, allowing detection of single-copy transition boundaries even in specimens with a high proportion of normal cells.

In an embodiment, the apparatus is representational oligonucleotide microarray analysis (RONA). ROMA has an increased resolution over standard CGH and is more fully described in US 2007-0207481 A1, Sep. 6, 2007, Use of ROMA for characterizing genomic rearrangements; Lucito R et al. Representational oligonucleotide microarray analysis: a high-resolution method to detect genome copy number variation. Genome Res. 2003 October; 13(10):2291-305; and Hicks et al. Novel patterns of genome rearrangement and their association with survival in breast cancer. Genome Res. 2006 December; 16(12):1465-79, the disclosures of which are incorporated herein by reference.

In an alternative embodiment of the instant methods, the apparatus is fluorescent in situ hybridization (FISH) apparatus.

FISH is a cytogenetic technique used to detect and localize the presence or absence of specific DNA sequences on chromosomes. FISH uses fluorescent probes that bind to only those parts of the chromosome with which they show a high degree of sequence similarity. As "probe" is understood any ribopolynucleotide or desoxiribopolynucleotide sequence that specifically binds to only those parts of the chromosome with which they show a high degree of sequence similarity. The probe must be large enough to hybridize specifically with its target but not so large as to impede the hybridization process.

Many different FISH probes can be used in the present invention without limitation, e.g. probes derived from bacterial artificial chromosomes (BACs). Tiling Oligonucleotide Probes (TOPs), etc. The design of FISH probes is well know for a person skilled in the art (Bayani J, Squire J A. Curr Protoc Cell Biol. 2004 September; Chapter 22:Unit 22.4; Bayani J, Squire J. Curr Protoc Cell Biol. 2004 October; Chapter 22:Unit 22.5.; Navin, N. et al. Bioinformatics, Volume 22. Number 19, 1 Oct. 2006, pp. 2437-2438 (2)) Publisher: Oxford University Press).

The probe can be tagged directly with fluorophores, with targets for antibodies, or with biotin. Tagging can be done in various ways, such as nick translation, or PCR using tagged nucleotides.

The sample can be fixed and paraffin embedded. Thus, an additional step of deparaffination may be performed.

For hybridization, an interphase or metaphase chromosome preparation may be produced. The chromosomes are firmly attached to a substrate, usually glass. Repetitive DNA sequences must be blocked by adding short fragments of DNA to the sample. The probe is then applied to the chromosome DNA and incubated for approximately 12 hours while hybridizing. Several wash steps remove all unhybridized or partially-hybridized probes. After standard post hybridization washes the slides are stained with the DNA staining probe such DAPI and mounted with a mounting agent such as antifade. The present invention is not limited by these examples and any DNA staining probe and/or mounting agent readily known to those of skill in the art may be used.

The results are then visualized and quantified using a microscope that is capable of exciting the dye and recording images. If the fluorescent signal is weak, amplification of the signal may be necessary in order to exceed the detection threshold of the microscope. Fluorescent signal strength depends on many factors such as probe labeling efficiency, the type of probe, and the type of dye. Fluorescently-tagged antibodies or streptavidin are bound to the dye molecule. These secondary components are selected so that they have a strong signal. In an embodiment, prior to imaging all slides are evaluated by a pathologist and regions of interest are identified based on histopathologic and quality criteria including, without excluding others, tumor content, appropriate fixation, necrosis and vascularity.

The term "sample" has been previously defined and can be applied to any type of biological sample from a patient, such as a biopsy sample, tissue, cell or fluid (serum, saliva, semen, sputum, cerebral spinal fluid (CSF), tears, mucus, sweat, milk, brain extracts and the like). In a particular embodiment, said sample is a tumour tissue sample or portion thereof. In a more particular embodiment, said tumor tissue sample is a breast tumor tissue sample from a patient suffering from breast cancer or a formalin embedded breast tissue sample.

In a particular embodiment of the instant methods, determining if the copy number is indicative of a deletion at marker D3, a deletion at marker D11, a deletion at marker D26, a deletion at marker D31, a deletion at marker D57, a deletion at marker D58, an amplification at marker A1, an amplification at marker A73, and/or an amplification at marker B, comprises comparing the copy number of the selected marker or markers to the copy number of a diploid reference. Copy number can then be defined as the ratio of hybridization signal at any locus in the genome comparing a tumor DNA sample to a DNA sample from the standard diploid reference.

A method is provided of treating a human subject afflicted with cancer comprising:
obtaining information indicative of whether the human subject is a candidate for trastuzumab therapy, the information based on
a copy number of human chromosome region Chr18: 309355-76106388 (marker D3), human chromosome region Chr15:20444124-88087873 (marker D11), human chromosome region Chr8:2780282-31010773 (marker D26), human chromosome region Chr17: 1612008-46199917 (marker D31), human chromosome region Chr18:44824169-76106388 (marker D57), human chromosome region Chr17:36157799-41605371 (marker D58), human chromosome region Chr11:5755441-5766622 (marker A1), human chromosome region Chr11:5755441-5756473 (marker A73) or human chromosome region 4q169.81-q185.239 (marker B), wherein the subject is a candidate for trastuzumab therapy if the copy number data is indicative of a deletion at marker D3, a deletion at marker D11, a deletion at marker D26, a deletion at marker D31, a deletion at marker D57, a deletion at marker D58, an amplification at marker A1, an amplification at marker A73, or an amplification at marker B; and if the information indicates that the human subject is a candidate for trastuzumab therapy, then administering to the human subject an amount of trastuzumab effective to treat the human subject afflicted with cancer.

In an embodiment of the method the information is based on copy number of marker D3, marker D11, marker D26, marker D31, marker D57, marker D58, marker A1, or marker A73.

In an embodiment of the method, the information is based on a copy number of two of the markers D3, D11, D26, D31, D57, D58, A1, A73, or B, the copy number data of the two markers being indicative of the subject's sensitivity to trastuzumab therapy. The copy number can be determined for any combination or permutation of two of the markers. In an embodiment, the two markers are D3 and D57. In another embodiment, the two markers are D31 and D58.

In an embodiment of the method, the information is based on a copy number of three of the markers D3, D11, D26, D31, D57, D58, A1, A73, or B, the copy number data of the three markers being indicative of the subject's sensitivity to trastuzumab therapy. The copy number can be determined for any combination or permutation of three markers.

In an embodiment of the method, the information is based on a copy number of four of the markers D3, D11, D26, D31, D57, D58, A1, A73, or B, the copy number data of the four markers being indicative of the subject's sensitivity to trastuzumab therapy. The copy number can be determined for any combination or permutation of four markers.

In an embodiment of the method, the information is based on a copy number of five of the markers D3, D11, D26, D31, D57, D58, A1, A73, or B, the copy number data of the five markers being indicative of the subject's sensitivity to trastuzumab therapy. The copy number can be determined for any combination or permutation of five markers.

In an embodiment of the method, the information is based on a copy number of six of the markers D3, D11, D26, D31, D57, D58, A1, A73, or B, the copy number data of the six markers being indicative of the subject's sensitivity to trastuzumab therapy. The copy number can be determined for any combination or permutation of six markers.

In an embodiment of the method, the information is based on a copy number of seven of the markers D3, D11, D26, D31, D57, D58, A1, A73, or B, the copy number data of the seven markers being indicative of the subject's sensitivity to trastuzumab therapy. The copy number can be determined for any combination or permutation of seven markers.

In an embodiment of the method, the information is based on a copy number of eight of the markers D3, D11, D26, D31, D57, D58, A1, A73, or B, the copy number data of the eight markers being indicative of the subject's sensitivity to trastuzumab therapy. The copy number can be determined for any combination or permutation of eight markers.

In an embodiment of the method, the information is based on a copy number of all nine of the markers D3, D11, D26, D31, D57, D58, A1, A73, and B, the copy number data of the nine markers being indicative of the subject's sensitivity to trastuzumab therapy.

An embodiment of the method further comprises obtaining additional information indicative of whether the human subject is a candidate for trastuzumab therapy based on a copy number of one or both of human chromosome region 17q35.42-q56.76 (marker D1) and human chromosome region 17q32.010-34.215 (marker D2), wherein the subject is a candidate for trastuzumab therapy if the copy number is indicative of a deletion at one or both of marker D1 and marker D2.

In a particular embodiment of the instant methods, determining if the copy number is indicative of a deletion of 17q35.42-q56.76, a deletion of 17q32.010-q32.34.215, and/or an amplification of 4q169.81-q185.239 comprises comparing the copy number of the selected marker or markers to the copy number of a diploid reference. Copy number can then be defined as the ratio of hybridization signal at any locus in the genome comparing a tumor DNA sample to a DNA sample from the standard diploid reference.

A method is provided of treating a human subject afflicted with cancer comprising:

a) obtaining information indicative of whether the human subject is a candidate for trastuzumab therapy, the information based on a copy number of human chromosome region 17q35.42-q56.76, human chromosome region 17q32.010-q32.34.215 or human chromosome region 4q169.81-q185.239, wherein the subject is a candidate for trastuzumab therapy if the copy number data is indicative of a deletion at 17q35.42-q56.76, a deletion at 17q32.010-q32.34.215 or an amplification at 4q169.81-q185.239; and b) if the information indicates that the human subject is a candidate for trastuzumab therapy, then administering to the human subject an amount of trastuzumab effective to treat the human subject afflicted with cancer.

In an embodiment of the method, the information is based on a copy number of two of 17q35.42-q56.76, 17q32.010-q32.34.215 or 4q169.81-q185.239, the copy number data of the two markers being indicative of the subject's sensitivity to trastuzumab therapy. The copy number can be determined for any combination or permutation of two of the three markers, including but not limited to 17q35.42-q56.76/17q32.010-q32.34.215, 17q35.42-q56.76/4q169.81-q185.239 or 17q32.010-q32.34.215/4q169.81-q185.239.

In an embodiment of the method, the information is based on a copy number of all three of 17q35.42-q56.76, 17q32.010-q32.34.215 and 4q169.81-q185.239, the copy number data of the three markers being indicative of the subject's sensitivity to trastuzumab therapy.

In an embodiment, the subject is Her2−. In an embodiment, the subject is Her2+.

The methods provided herein to identify a subject as a candidate for trastuzumab therapy can also be used to determine the sensitivity of a subject to trastuzumab therapy and/or predict the responsiveness of a subject to trastuzumab therapy, wherein the subject has cancer.

If the copy numbers of the markers are not determined simultaneously, then the copy number of each marker can be determined in any order.

In a particular embodiment, the subject has breast cancer. In another embodiment, the subject has breast cancer cells. In other embodiments, the candidate subject has been previously diagnosed as having cancer cells from diseases including, but not limited to, leukemia, brain cancer, kidney cancer, lymphoma, eye cancer, connective tissue cancer, Hodgkin's disease, bone cancer, testicular cancer, cervical cancer, thyroid cancer, melanoma, skin cancer, uterine cancer, lung cancer, colon cancer, rectal cancer, ovarian cancer, bladder cancer, larynx cancer, prostate cancer, stomach cancer, breast cancer, and pancreatic cancer. In another embodiment the subject has a cancer affected by changes in the Human Epidermal growth factor Receptor 2 (Her2) pathway.

In an embodiment, trastuzumab therapy is administered as a monotherapy. In another embodiment, trastuzumab therapy is administered as an adjuvant therapy.

In order to carry out the invention, a sample is obtained from the subject under study. In a particular embodiment, said sample is a tumour tissue sample or portion thereof. In a more particular embodiment, said tumor tissue sample is a breast tumor tissue sample from a patient suffering from breast cancer. Said sample can be obtained by conventional methods, e.g., biopsy, by using methods well known to those of ordinary skill in the related medical arts. Methods for obtaining the sample from the biopsy include gross apportioning of a mass, or microdissection or other art-known cell-separation methods. Tumour cells can additionally be obtained from fine needle aspiration cytology.

Samples can be obtained from subjects previously diagnosed or not diagnosed with breast cancer, or from subjects who are receiving or have previously received anti-breast cancer treatment. In a particular embodiment, samples can be obtained from patients who have not previously received any anti-breast cancer treatment.

In order to simplify conservation and handling of the samples, these can be formalin-fixed and paraffin-embedded or first frozen and then embedded in a cryosolidifiable medium, such as OCT-Compound, through immersion in a highly cryogenic medium that allows for rapid freeze.

In a particular embodiment, the copy number of a marker, including but not limited to D3, D11, D26, D31, D57, D58, A1, A73, B, D1, D2, or Her2, is determined using nucleic acids obtained from fresh tissue from a biopsy or fine needle aspiration cytology.

Fixed and paraffin-embedded tissue samples are broadly used storable or archival tissue samples in the field of oncology. Nucleic acid may be isolated from an archival pathological sample or biopsy sample which is first deparaffinized.

An exemplary deparaffinization method involves washing the paraffinized sample with an organic solvent, such as xylene, for example. Deparaffinized samples can be rehydrated with an aqueous solution of a lower alcohol. Suitable lower alcohols, include, for example, methanol, ethanol, propanols, and butanols. Deparaffinized samples may be rehydrated with successive washes with lower alcoholic solutions of decreasing concentration, for example. Alternatively, the sample may be simultaneously deparaffinized and rehydrated. The sample is then lysed and nucleic acid is extracted from the sample. As an illustrative, non limitative example, tissue selected for fixation and paraffin embedding can be fixed in 10% buffered formalin for 16 hours to 48 hours. After this period of time, said tissue will be embedded in paraffin following conventional techniques. Nevertheless, nucleic acid quality issues are especially delicate when analyzing formalin-fixed tissue samples.

In a particular embodiment, the copy number of a marker, including but not limited to D3, D11, D26, D31, D57, D58, A1, A73, B, D1, D2, or Her2, is determined using nucleic acids obtained from a biopsy tissue sample or fine needle aspiration cytology. Because of the variability of the cell types in diseased-tissue biopsy material, and the variability in sensitivity of the diagnostic methods used, the sample size required for analysis may range from 1, 10, 50, 100, 200, 300, 500, 1,000, 5,000, 10.000, to 50,000 or more cells. The appropriate sample size may be determined based on the cellular composition and condition of the biopsy or cytology, and the standard preparative steps for this determination and subsequent isolation of the nucleic acid for use in the invention are well known to one of ordinary skill in the art.

Using standard methods, the biological sample may be treated to physically or mechanically disrupt tissue or cell structure, to release intracellular components into an aqueous or organic solution to prepare nucleic acids for further analysis. The nucleic acids may be extracted from the sample by procedures known to the skilled person and commercially available. In a particular embodiment, the total DNA extracted from tissue samples represents the working material suitable for subsequent detection of the genetic marker of interest. Once the sample has been obtained and the total DNA has been extracted, amplification of nucleic acid may be carried out in order to produce sufficient sample material for further detection procedures. Several techniques can be used for producing sufficient starting material. These techniques include polymerase chain reaction (PCR), degenerate primer PCR using one or several sets of primers, rolling circle amplification, etc. Examples of techniques sufficient to direct persons of skill through in vitro amplification methods are found in Mullis, et al., U.S. Pat. No. 4,683,202 (1987); and Innis, et al., PCR Protocols A Guide to Methods and Applications, Eds., Academic Press Inc., San Diego, Calif. (1990). Commercially available kits for isolation of nucleic acids from FFPE tissues and for genomic PCR amplification are known in the art. See, e.g., RecoverAll™ Total Nucleic Acid Isolation Kit for FPPE (Ambion) and WGA1 GenomePlex® Whole Genome Amplification Kit (Sigma).

In a particular embodiment, the amplification of the DNA is carried out by means of PCR. The general principles and conditions for amplification and detection of nucleic acids, such as using PCR, are well known for the skilled person in the art.

The instant invention provides a kit for identifying a subject's sensitivity to trastuzumab therapy, said kit comprising one or more nucleic acid probes each of which selectively bind to a target polynucleotide sequence of the chromosome region comprising one of human chromosome region Chr18:309355-76106388 (marker D3), human chromosome region Chr15:20444124-88087873 (marker D11), human chromosome region Chr8:2780282-31010773 (marker D26), human chromosome region Chr17:1612008-46199917 (marker D31), human chromosome region Chr18:44824169-76106388 (marker D57), human chromosome region Chr17:36157799-41605371 (marker D58), human chromosome region Chr11:5755441-5766622 (marker A1), human chromosome region Chr11:5755441-5756473 (marker A73) or human chromosome region 4q169.81-q185.239 (marker B) under conditions in which the probe forms a stable hybridization complex with the target polynucleotide sequence. An embodiment of the kit contains one or more nucleic acid probes which selectively bind to target polynucleotide sequences of the chromosome regions comprising two of markers D3, D31, D57, D58, or B.

In an embodiment, the kit contains one or more nucleic acid probes each of which selectively bind to a target polynucleotide sequence of the chromosome region comprising one of markers D3, D11, D26, D31, D57, D58, A1, or A73.

An embodiment of the kit contains one or more nucleic acid probes which selectively bind to target polynucleotide sequences of the chromosome regions comprising two of markers D3, D11, D26, D31, D57, D58, A1, A73, or B.

An embodiment of the kit contains one or more nucleic acid probes which selectively bind to target polynucleotide sequences of the chromosome regions comprising three of markers D3, D11, D26, D31, D57, D58, A1, A73, or B.

An embodiment of the kit contains one or more nucleic acid probes which selectively bind to target polynucleotide sequences of the chromosome regions comprising four of markers D3, D11, D26, D31, D57, D58, A1, A73, or B.

An embodiment of the kit contains one or more nucleic acid probes which selectively bind to target polynucleotide sequences of the chromosome regions comprising five of markers D3, D11, D26, D31, D57, D58, A1, A73, or B.

An embodiment of the kit contains one or more nucleic acid probes which selectively bind to target polynucleotide sequences of the chromosome regions comprising six of markers D3, D11, D26, D31, D57, D58, A1, A73, or B.

An embodiment of the kit contains one or more nucleic acid probes which selectively bind to target polynucleotide sequences of the chromosome regions comprising seven of markers D3, D11, D26, D31, D57, D58, A1, A73, or B.

An embodiment of the kit contains one or more nucleic acid probes which selectively bind to target polynucleotide sequences of the chromosome regions comprising eight of markers D3, D11, D26, D31, D57, D58, A1, A73, or B.

An embodiment of the kit contains one or more nucleic acid probes which selectively bind to target polynucleotide sequences of the chromosome regions comprising nine of markers D3, D11, D26, D31, D57, D58, A1, A73, and B.

An embodiment of the kit further comprises one or more nucleic acid probes each of which selectively bind to a target polynucleotide sequence of a chromosome region selected from the group consisting of: human chromosome region 17q35.42-q56.76 (marker D1) and human chromosome region 17q32.010-34.215 (marker D2).

An embodiment of the kit further comprises one or more nucleic acid probes which selectively bind to a target polynucleotide sequence of the chromosome region comprising Her2/neu.

Probes can be obtained from commercial sources or they can be made non-commercially using well known techniques. A technique to design probes is disclosed in US 2005-0032095 A1, published Feb. 10, 2005, Virtual representations of nucleotide sequences, the disclosure of which is incorporated by reference. Sources of DNA for use in constructing DNA probes include genomic DNA, cloned DNA sequences such as bacterial artificial chromosomes (BAC), somatic cell hybrids that contain one or a part of a human chromosome along with the normal chromosome complement of the host, and chromosomes purified by flow cytometry or microdissection. The region of interest can be isolated through cloning or by site-specific amplification via the polymerase chain reaction (PCR). See, for example, Nath, et al., Biotechnic Histochem, 1998, 73 (1): 6-22; Wheeless. et al., Cytometry, 1994, 17:319-327; and U.S. Pat. No. 5,491,224. Synthesized oligomeric DNA or PNA probes can also be used.

The size of the chromosomal region detected by the probes used in the invention can vary. For locus-specific probes that are directly labeled, probes of at least 100,000 bases in complexity may be used, and unlabeled blocking nucleic acid may be used, as disclosed in U.S. Pat. No. 5,756,696, herein incorporated by reference, to avoid non-specific binding of the probe. It is also possible to use unlabeled, synthesized oligomeric nucleic acid or protein nucleic acid as the blocking nucleic acid. For targeting a particular gene locus, the probes may span approximately the entire genomic coding locus of the gene.

Chromosomal probes can contain any detection moiety that facilitates the detection of the probe when hybridized to a chromosome. Effective detection moieties include both direct and indirect labels as described below. An embodiment of the instant kit contains a nucleic acid probe or probes which are directly labeled. An embodiment of the instant kit contains a nucleic acid probe or probes which are indirectly labeled.

Chromosomal probes can be directly labeled with a detectable label. Examples of detectable labels include fluorophores (i.e., organic molecules that fluoresce after absorbing light), radioactive isotopes (e.g., 32p, and 3H) and chromophores (e.g., enzymatic markers that produce a visually detectable marker). Fluorophores are preferred and can be directly labeled following covalent attachment to a nucleotide by incorporating the labeled nucleotide into the probe with standard techniques such as nick translation, random priming, and PCR labeling. Alternatively, deoxycytidine nucleotides within the probe can be transaminated with a linker. The fluorophore can then be covalently attached to the transaminated deoxycytidine nucleotides. See, e.g., U.S. Pat. No. 5,491,224 to Bittner, et al., which is incorporated herein by reference. Useful probe labeling techniques are described in Molecular Cytogenetics: Protocols and Applications, Y.-S. Fan, Ed., Chap. 2, "Labeling Fluorescence In Situ Hybridization Probes for Genomic Targets", L. Morrison et. al., p. 21-40, Humana Press, © 2002 (hereafter cited as "Morrison 2002"), incorporated herein by reference.

Examples of fluorophores that can be used in the methods described herein are: 7-amino-4-methylcoumarin-3-acetic acid (AMCA), Texas Red™ (Molecular Probes, Inc., Eugene, Oreg.); 5-(and-6)-carboxy-X-rhodamine, lissamine rhodamine B, 5-(and-6)-carboxyfluorescein; fluorescein-5-isothiocyanate (FITC); 7-diethylaminocoumarin-3-carboxylic acid, tetramethylrhodamine-5-(and-6)-isothiocyanate; 5-(and -6)-carboxytetramethylrhodamine; 7-hydroxycoumarin-3-carboxylic acid; 6-[fluorescein 5-(and-6)-carboxamido]hexanoic acid; N-(4,4-difluoro-5, 7-dimethyl-4-bora-3a,4a diaza-3-indacenepropionic acid; eosin-5-isothiocyanate; erythrosine-5-isothiocyanate; 5-(and-6)-carboxyrhodamine 6G; and Cascade™ blue acetylazide (Molecular Probes, Inc., Eugene, Oreg.).

When multiple probes are used, fluorophores of different colors can be chosen such that each chromosomal probe in the set can be distinctly visualized. Preferably the probe panel of the invention will comprise two or three separate probes, each labeled with a separate fluorophore. Use of four probes may be preferred as providing the best balance between clinical sensitivity (sensitivity can increase with added probes) and imaging/detection complexity (complexity can increase with added probes). It is also within the scope of the invention to use multiple panels sequentially on the same sample: in this embodiment, after the first panel is hybridized, the results are imaged, the sample is destained and then is hybridized with a second panel. Multiple panels may also be hybridized each to a different portion of the same specimen. e.g. to serial sections from a paraffin block of a fixed and embedded specimen.

Probes can be viewed with a fluorescence microscope and an appropriate filter for each fluorophore, or by using dual or triple band-pass filter sets to observe multiple fluorophores. See, e.g., U.S. Pat. No. 5,776,688 to Bittner, et al., which is incorporated herein by reference. Any suitable microscopic imaging method can be used to visualize the hybridized probes, including automated digital imaging systems, such as those available from MetaSystems or Applied Imaging. Alternatively, techniques such as flow cytometry can be used to examine the hybridization pattern of the chromosomal probes.

Probes can also be labeled indirectly, e.g., with biotin or digoxygenin by means well known in the art. However, secondary detection molecules or further processing are then required to visualize the labeled probes. For example, a probe labeled with biotin can be detected by avidin conjugated to a detectable marker, e.g., a fluorophore. Additionally, avidin can be conjugated to an enzymatic marker such as alkaline phosphatase or horseradish peroxidase. Such enzymatic markers can be detected in standard calorimetric reactions using a substrate for the enzyme. Substrates for alkaline phosphatase include 5-bromo-4-chloro-3-indolyl-phosphate and nitro blue tetrazolium. Diaminobenzoate can be used as a substrate for horseradish peroxidase.

The probes and probe sets useful with the methods of the invention can be packaged with other reagents into kits to be used in carrying out the methods of the invention. Useful probe sets and kits can comprise probes to Her2 and probes to one or more of markers D3, D11, D26, D31, D57, D58, A1, A73, and B. Additionally, probe sets and kits may only include a probe or probes to one or more of marker D3, D11, D26, D31, D57, D58, A1, A73, and B. Alternatively, one or more reference probes may be included in the kits already mentioned.

In a further embodiment, an array-based format can be used in which the nucleic acids or the nucleic acid probes of the invention are attached to a solid surface. In a further embodiment, the attached probe or probes comprise a nucleic acid array. In this type of format, a large number of different hybridization reactions can be run essentially "in parallel." This provides rapid, essentially simultaneous, evaluation of a large number of nucleic acid probes. Methods for immobilizing the polynucleotides on the surface and derivatizing the surface are known in the art; see, for example, U.S. Pat. No. 6,664,057, and are also described above. These arrays can be used in CGH or ROMA analysis.

In a further embodiment, the kit comprises instructional material which teaches that the detection of one or more of a deletion at marker D3, a deletion at marker D11, a deletion at marker D26, a deletion at marker D31, a deletion at marker D57, a deletion at marker D58, an amplification at marker A1, an amplification at marker A73, or an amplification at marker B indicates that a subject is likely to be sensitive to trastuzumab therapy.

In another embodiment, the invention relates to the use of a kit of the invention for identifying a subject as a candidate for trastuzumab therapy, wherein if said components of the kit detect a deletion at marker D3, a deletion at marker D11, a deletion at marker D26, a deletion at marker D31, a deletion at marker D57, a deletion at marker D58, an amplification at marker A1, an amplification at marker A73, or an amplification at marker B, then the subject will be considered a candidate for trastuzumab therapy.

The invention further provides a method of identifying a genomic marker comprising: a) obtaining a set of genomic copy number profiles; b) deriving from the set of genomic copy number profiles a set of N copy number events Aj, wherein j=1, . . . , N and wherein each copy number event is associated with a specific interval of the genome and a real number Uj, wherein $0 \leq Uj \leq 1$; c) setting Uj to 1; d) determining for each copy number event Aj and an interval I an explanation value Ej(I), wherein Ej(I)=UjL(I)/L(Aj) if I is contained in Aj and Ej(I)=0 if I is not contained in Aj, and wherein L(I) is the length of interval I and L(Aj) is the length of copy number event Aj; e) summing the values determined in step (d) for interval I to provide an explanation of the set of copy number events, E(I); f) determining an optimal explanation value S of the set of copy number events and a corresponding optimal explaining interval C, wherein S=maxIE(I) and wherein C=argmaxIE(I); g) updating Uj by subtracting the value of C determined in step (f) for all j=1, . . . , N; h) repeating step (d) through step (g) at least one time; and i) selecting an optimal explaining interval whose optimal explanation value is statistically significant, thereby identifying an optimal explaining interval as a genomic marker.

In an embodiment, the set of genomic copy number profiles are obtained from subjects afflicted with a cancer.

In an embodiment, the subjects are Her2−.

In an embodiment, the subjects are Her2+.

In an embodiment, the subjects have a cancer affected by changes in the Her2/neu pathway.

In an embodiment, the subjects have breast cancer.

In an embodiment, the genomic marker is indicative of sensitivity to trastuzumab therapy.

All publications and other references mentioned herein are incorporated by reference in their entirety, as if each individual publication or reference were specifically and individually indicated to be incorporated by reference. Publications and references cited herein are not admitted to be prior art.

Examples are provided below to facilitate a more complete understanding of the invention. The following examples illustrate the exemplary modes of making and practicing the invention. However, the scope of the invention is not limited to specific embodiments disclosed in these Examples, which are for purposes of illustration only, since alternative methods can be utilized to obtain similar results.

EXAMPLES

Example 1

CALGB9342

Samples of DNA were obtained from formalin-fixed paraffin-embedded (FFPE) tumor tissue samples from patients that had been enrolled in clinical trial CALGB9342. The details of the trial are described in Winer E P et al. "Failure of higher-dose paclitaxel to improve outcome in patients with metastatic breast cancer: cancer and leukemia group B trial 9342." *J Clin Oncol*. 2004 Jun. 1; 22(11): 2061-8, the disclosure of which in its entirety is hereby incorporated by reference into this application. A brief description of the study follows.

Purpose

Cancer and Leukemia Group B Protocol 9342 was initiated to determine the optimal dose of paclitaxel administered as a 3-hour infusion every 3 weeks to women with metastatic breast cancer.

Patients and Methods

Four hundred seventy-four women with metastatic breast cancer who had received one or no prior chemotherapy regimens were randomly assigned to one of three paclitaxel dosing regimens-175 mg/m$^2$, 210 mg/m$^2$, or 250 mg/m$^2$-each administered as a 3-hour infusion every 3 weeks. Women completed self-administered quality of life and symptom assessment questionnaires at baseline and after three cycles of treatment.

Results

No evidence of a significant dose-response relationship was demonstrated over the dose range assessed. Response rates were 23%, 26%, and 21% for the three regimens, respectively. A marginally significant association (P=0.04) was seen between dose and time to progression: however, in a multivariate analysis, the difference was even less apparent. No statistically significant difference was seen in survival. Neurotoxicity and hematologic toxicity were more severe on the higher dose arms. There was no significant difference in quality of life on the three arms.

Conclusion

Higher doses of paclitaxel administered as a 3-hour infusion to women with metastatic breast cancer did not improve response rate, survival, or quality of life. There was a slight improvement in time to progression with higher dose therapy, which was offset by greater toxicity. When a 3-hour infusion of paclitaxel is administered every 3 weeks, 175 mg/m$^2$ should be considered the optimal dose.

Example 2

CALGB9840

Samples of DNA were obtained from formalin-fixed paraffin-embedded (FFPE) tumor tissue samples from patients that had been enrolled in clinical trial CALGB9342. The details of the trial are described in Seidman A D et al. "Randomized phase III trial of weekly compared with every-3-weeks paclitaxel for metastatic breast cancer, with trastuzumab for all HER-2 overexpressors and random assignment to trastuzumab or not in HER-2 nonoverexpressors: final results of Cancer and Leukemia Group B protocol 9840." J Clin Oncol. 2008 Apr. 1:26(10):1642-9, the disclosure of which in its entirety is hereby incorporated by reference into this application. A brief description of the study follows.

Purpose

Phase II trials suggested that weekly paclitaxel might be more effective and less toxic than every-3-weeks administration for metastatic breast cancer (MBC). Cancer and Leukemia Group B (CALGB) protocol 9840 was initiated to address this question. Subsequently trastuzumab was demonstrated to improve outcomes of paclitaxel therapy for human epidermal growth factor receptor-2 (Her2)-positive patients, and was therefore incorporated. Because inhibition of Her-family signaling had potential efficacy even without Her2 overexpression, we randomly assigned for trastuzumab in this population.

Patients and Methods

Patients were randomly assigned to paclitaxel 175 mg/m$^2$ every 3 weeks or 80 mg/m$^2$ weekly. After the first 171 patients, all Her2-positive patients received trastuzumab; Her2 nonoverexpressors were randomly assigned for trastuzumab, in addition to paclitaxel schedule. A total of 577 patients were treated on 9840. An additional 158 patients were included in analyses, for combined sample of 735. The primary end point was response rate (RR); secondary end points were time to progression (TTP), overall survival, and toxicity. Primary comparisons were between weekly versus every-3-weeks paclitaxel, and trastuzumab versus no trastuzumab in Her2 nonoverexpressors.

Results

In the combined sample, weekly paclitaxel was superior to every-3-weeks administration: RR (42% v 29%, unadjusted odds ratio [OR]=1.75; P=0.0004), TTP (median, 9 v 5 months: adjusted HR_1.43; P<0.0001), and survival (median, 24 v 12 months; adjusted HR=1.28; P=0.0092). For Her2 nonoverexpressors, trastuzumab did not improve efficacy. Grade 3 neuropathy was more common with weekly dosing (24% v 12%; P=0.0003).

Conclusion

Weekly paclitaxel is more effective than every-3-weeks administration for NBC. Trastuzumab did not improve efficacy for Her2 nonoverexpressors. Neurotoxicity is a treatment-limiting toxicity for weekly paclitaxel.

Example 3

Materials and Methods

DNA was obtained from formalin-fixed paraffin-embedded (FPPPE) tumor tissue samples from patients that had been enrolled in clinical trials (CALGB9840 and CALGB9342). These trials were originally designed to test response to taxane chemotherapy along with response to Herceptin® (trastuzumab) therapy. DNA samples were anonymized, but associated with complete clinical information, including long term (>5 years) followup for disease progression, survival, histopathology and had been tested for Her2/neu (ERBB2) gene amplification by the clinical standard technique known as fluorescence in situ hybridization (FISH). mRNA gene expression data was also available for Her2/neu plus 700 additional genes. The sample set contained approximately equal numbers of four test categories: 1. Her2 FISH negative, untreated with Herceptin: 2. Her2 FISH positive (FISH ratio>2), untreated with Herceptin: 3. Her2 FISH negative, treated with Herceptin; 4. Her2 FISH positive, treated with Herceptin.

DNA Preparation.

DNA isolated from these samples was extracted using commercially available techniques for purifying DNA from FFPPE samples. DNA was stored frozen at −20° C.

Genome Copy Number Analysis

Whole genome copy number analysis was performed on high density microarrays supplied by Agilent (244K features) or NimbleGen (1.1 million features). Array hybridizations were performed by the two color method in comparison to a male standard for which naturally occurring copy number variations (CNV's) have been previously mapped. Intrachip normalization will be computed by a combination of LOWESS and LOCAL normalization algorithms. High density array data was resolved into discrete events (amplifications and deletions) using the KS segmenter algorithm (Hicks at al., *Genome Research,* 2006). Frequencies of events and patterns of events (e.g. Firestorm Index) will be calculated using methods described by Hicks et al (*Genome Research,* 2006). Correlations with clinical parameters were calculated using standard methods.

Statistical Analysis

Figure 2:
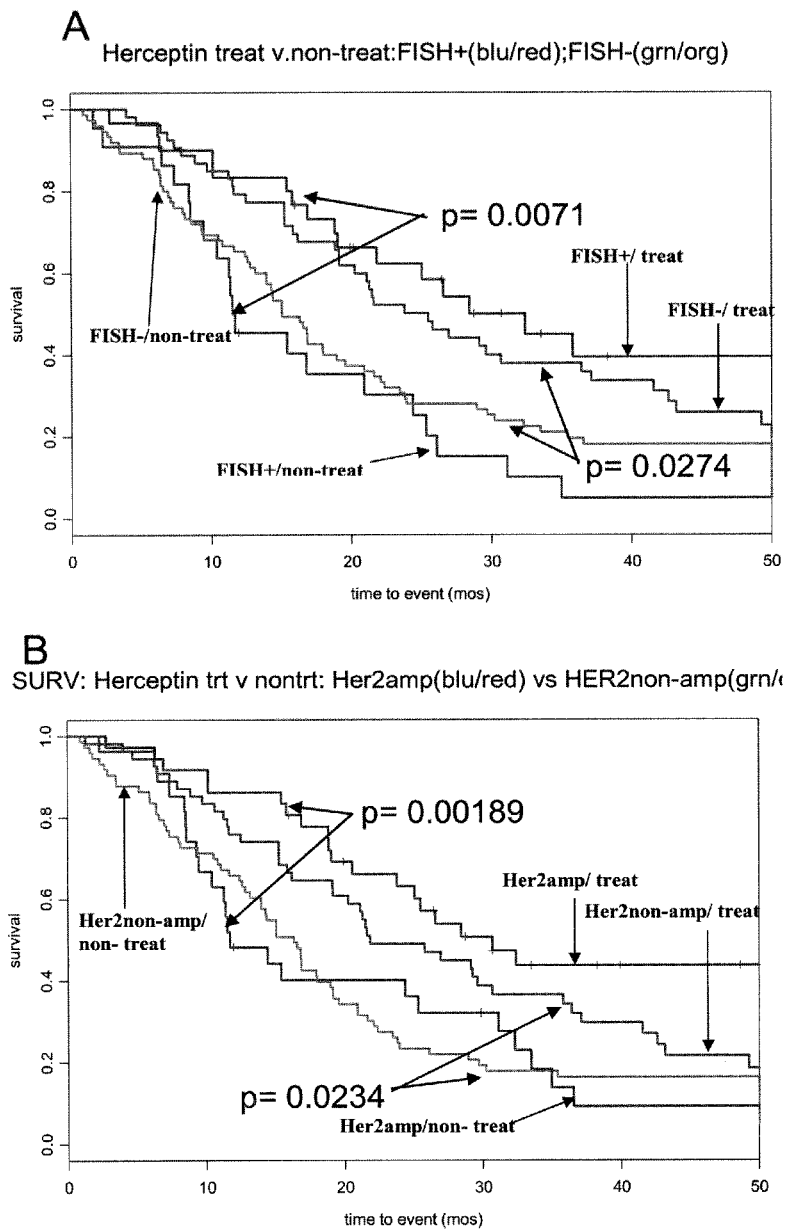
FIG. 2. Plot of trastuzumab response (treated vs. untreated) plotted as overall survival (y axis) over time in months (x axis) for patients assayed as ERBB2 amplified ("FISH+" and "HER2amp") or non-amplified ("FISH−" and "HER2non-amp") by FISH (FIG. 2A) or aCGH (FIG. 2B).
Figure 3A:
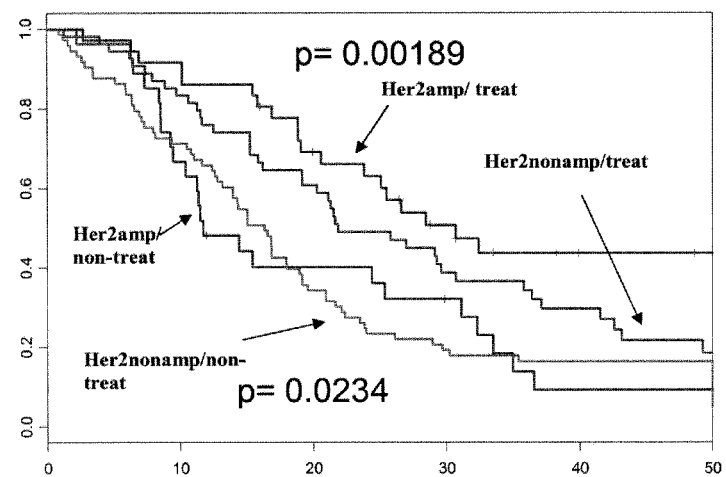
FIG. 3A. Plot of trastuzumab response measured as overall survival (treated vs. untreated) for patients assayed as positive for Her2 amplification by aCGH ("Her2amp") or negative for Her2 amplification by aCGH ("Her2nonamp").
Figure 3B:
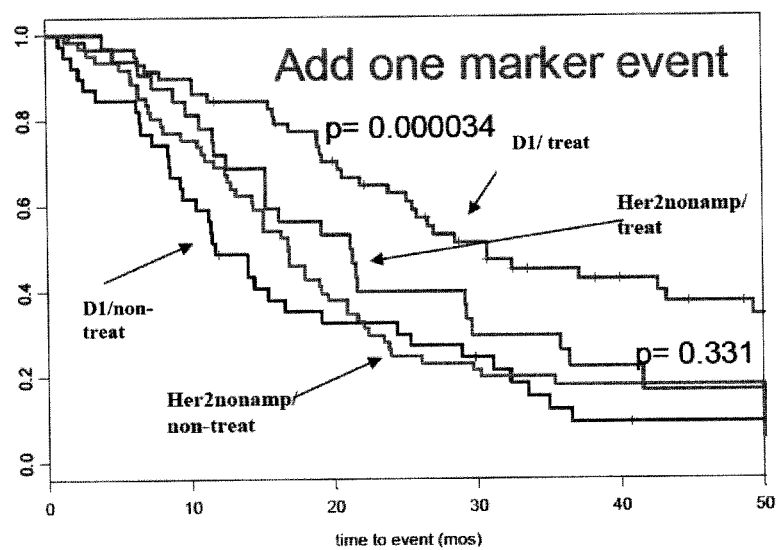
FIG. 3B. Plot of trastuzumab response measured as overall survival (treated vs. untreated) for patients assayed as positive for Her2 amplification by aCGH plus those negative for Her2 amplification but carrying a deletion at marker D1 ("D1") compared to those negative for Her2 amplification by aCGH and not carrying a deletion at marker D1 ("Her2nonamp").
Figure 3C:
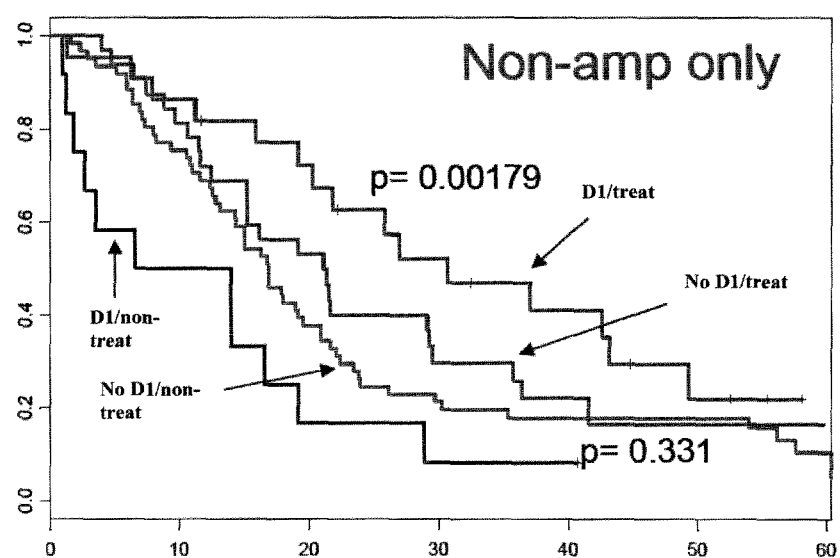
FIG. 3C. Plot of trastuzumab response measured as overall survival (treated vs. untreated) for patients assayed as negative for Her2 amplification by aCGH ("D1") and carrying a deletion at marker D1 or negative for Her2 amplification by aCGH not carrying a deletion at marker D1 ("No D1").
Figure 3D:
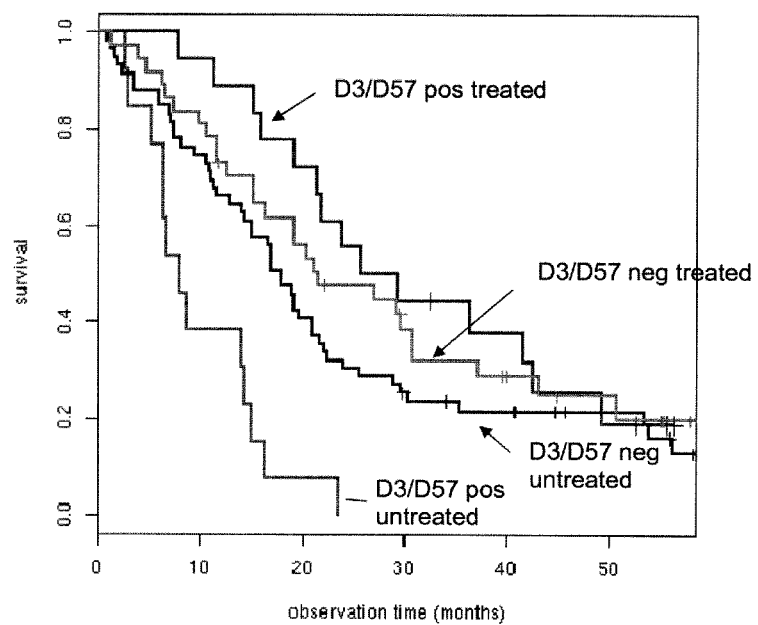
FIG. 3D. Plot of trastuzumab response measured as overall survival (treated vs. untreated) for patients assayed as negative for Her2 amplification and positive for deletions at combined marker D3/D57 compared to those negative for Her2 amplification and not carrying deletions at combined marker D3/D57.
Figure 3E:
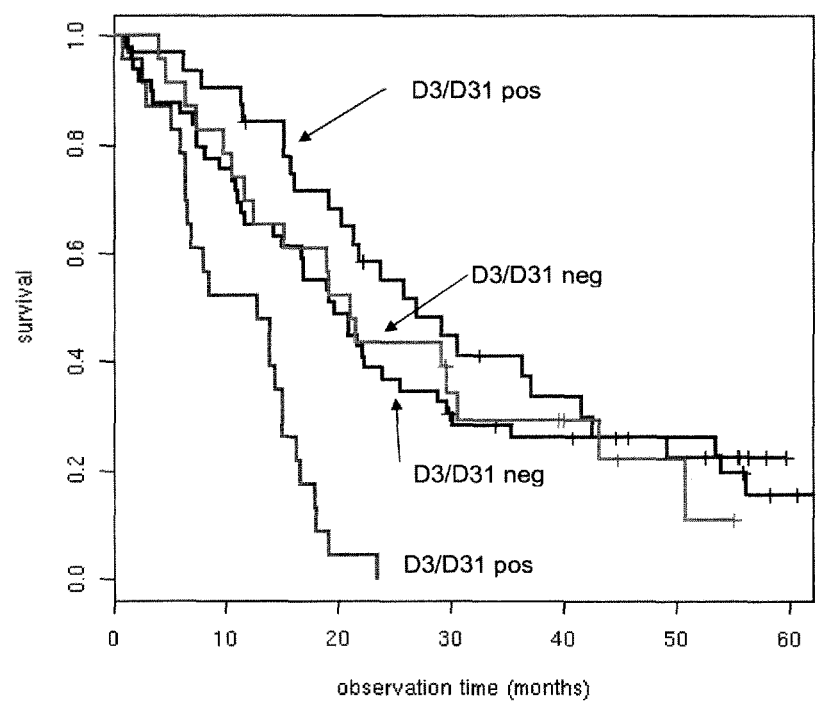
FIG. 3E. Plot of trastuzumab response measured as overall survival (treated vs. untreated) for patients assayed as negative for Her2 amplification and positive for a deletion at marker D3 or a deletion at marker D31 compared to those negative for Her2 amplification and not carrying a deletion at marker D3 or a deletion at marker D31.
Figure 3F:
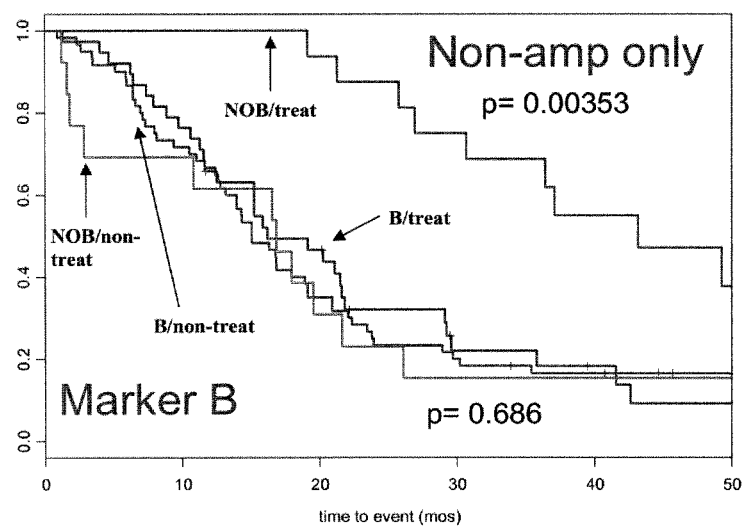
FIG. 3F. Plot of trastuzumab response measured as overall survival (treated vs. untreated) for patients assayed as negative for Her2 amplification by aCGH ("B") and carrying an amplification at marker B or negative for Her2 amplification by aCGH and not carrying an amplification at marker B ("NOB").
Figure 4A:
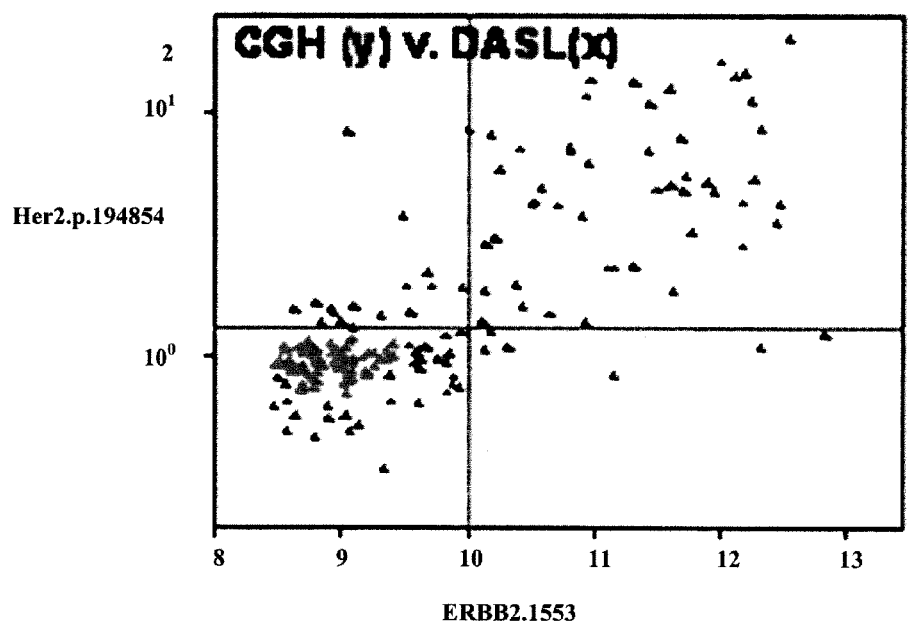
FIG. 4. Comparison of FISH, CGH and DASL Expression for ERBB2 (189 samples)
FIG. 4A. CGH (y) v. DASL (x)
FIG. 4B. FISH (y) v. DASL (x)
FIG. 4C. CGH (y) v. FISH (x)
FIG. 4D. DASL of CGH/FISH pos FIG. 5. Genotyping Distribution in 9840/9342 vs an Early Stage Cohort.
Figure 4B:
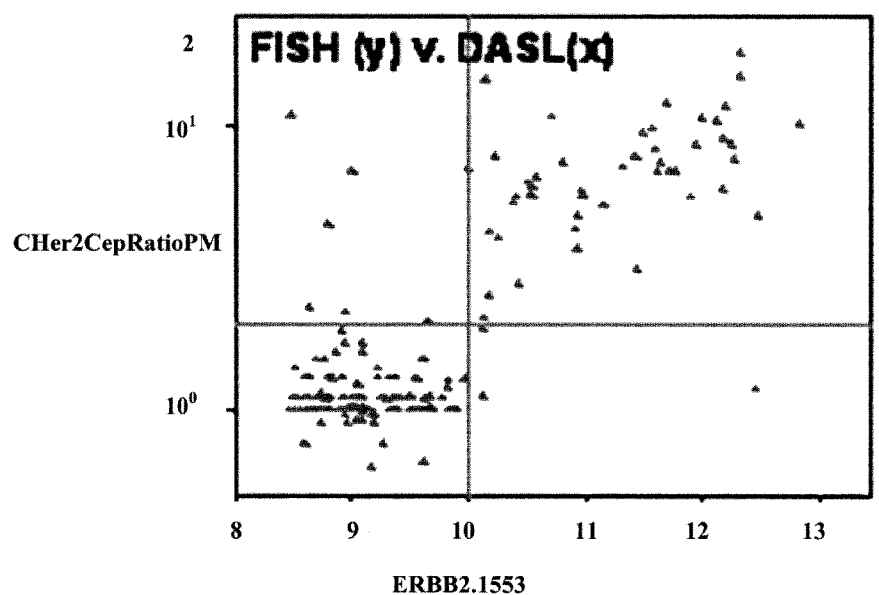
Figure 4C:
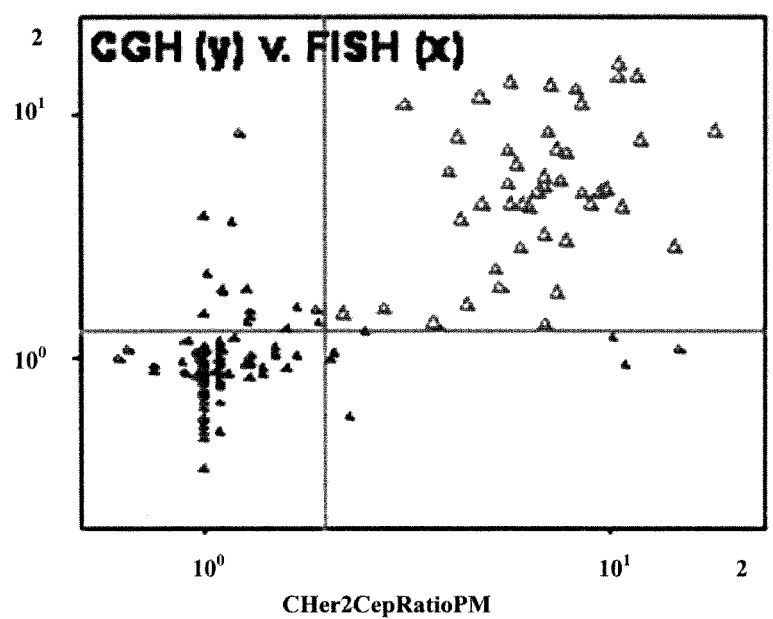
Figure 4D:
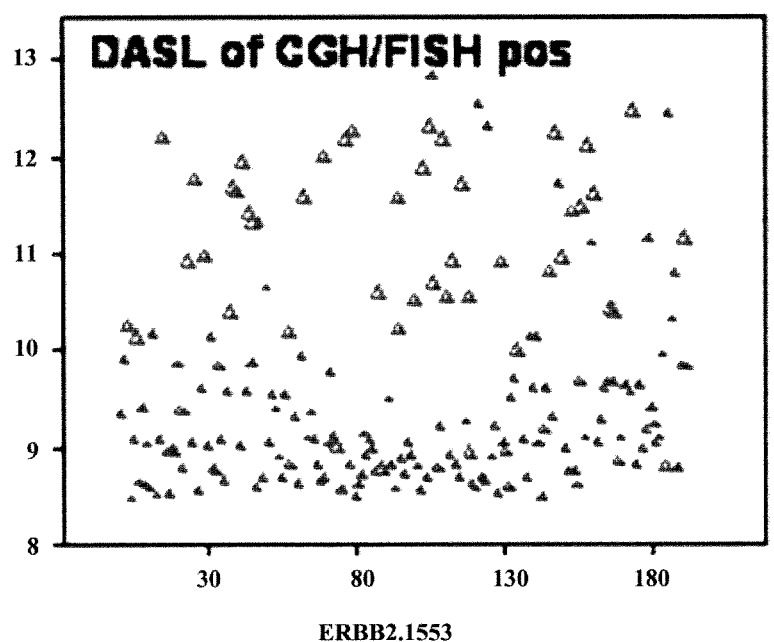
Figure 6A:
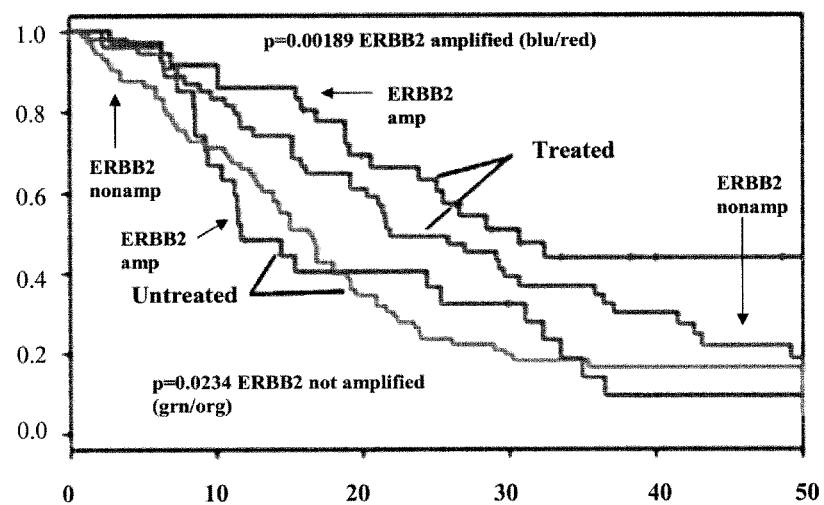
FIG. 6A. Trastuzumab extends survival (y axis) measured over months (x axis) for both ERBB2 amplified ("ERBB2 amp") and NON-amplified cases ("ERBB2 nonamp").
Figure 6B:
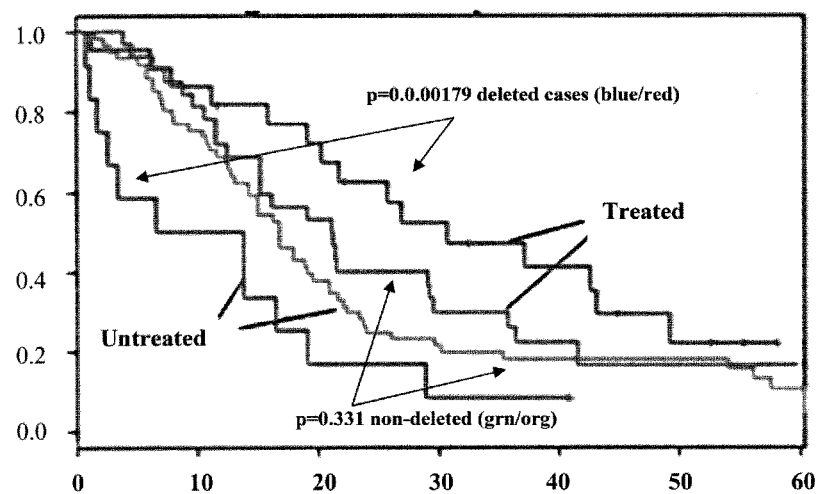
FIG. 6. CGH events that detect Trastuzumab responders among the ERBB2 NON-amplified cases.
FIG. 6C. Duplication of 4q(term) identifies increased Trastuzumab response among cases NOT amplified for ERBB2. Survival (y axis) measured over months (x axis).
FIG. 6D. Combining ERBB2 amp and NONamp carrying second marker treats more cases (87) than ERBB2 amp alone (53). Survival (y axis) measured over months (x axis).
Figure 6C:
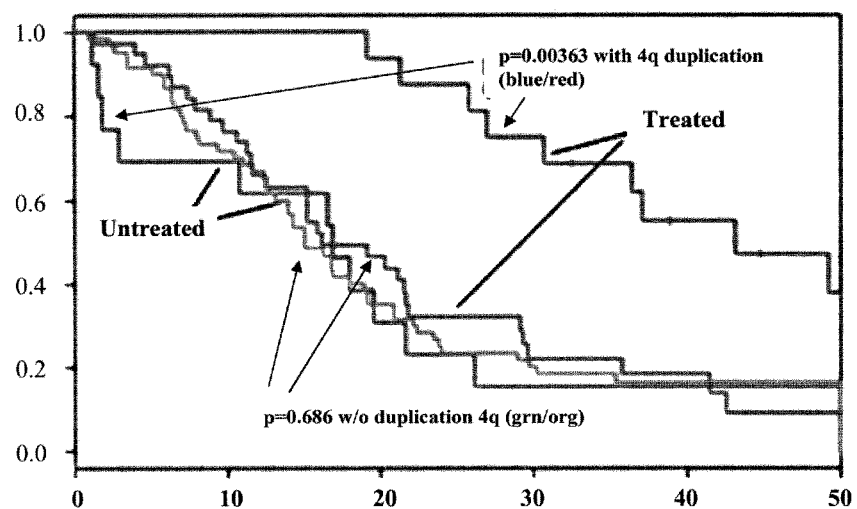
Figure 6D:
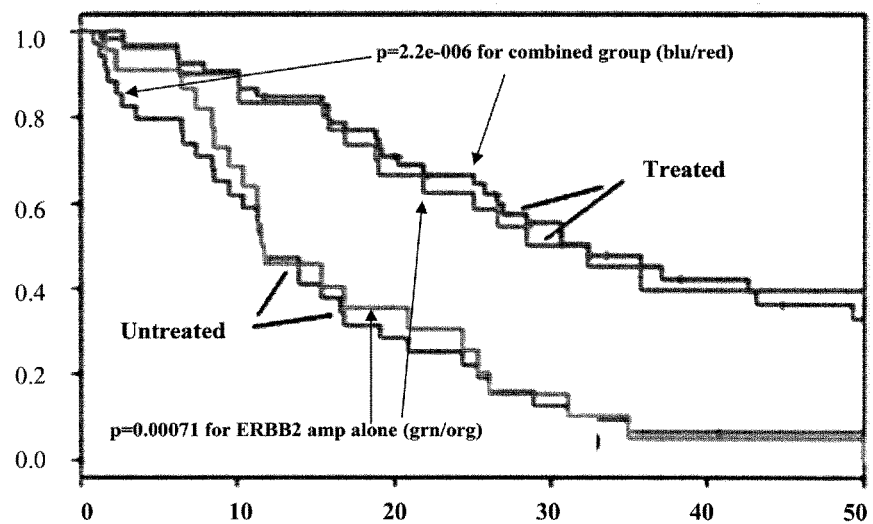
Figure 7A:
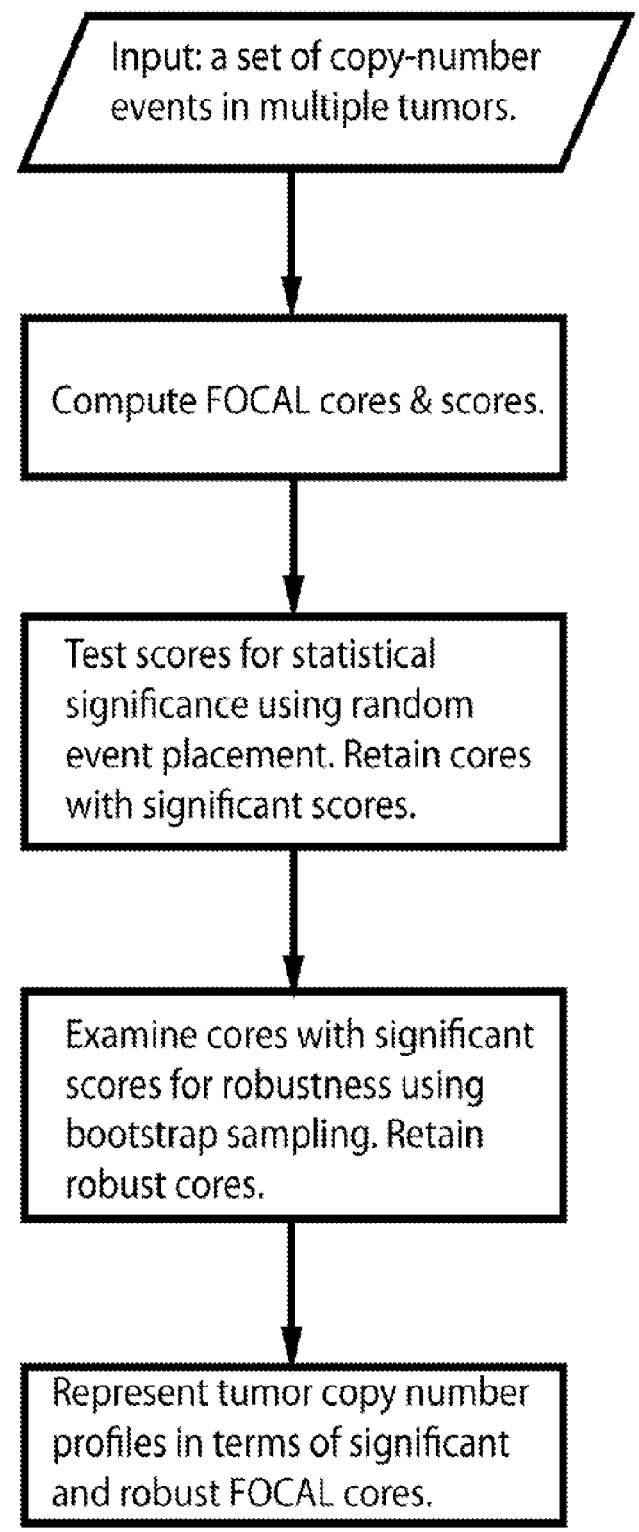
FIG. 7. Finder of Consistently Aberrant Loci (FOCAL)
FIG. 7A. Flowchart of FOCAL
FIG. 7B. Explanations provided by interval I to events $A_1$, $A_2$, $A_3$.
FIG. 7C. Main iteration loop of FOCAL for a set of four events (thick black horizontals). Five possible intersections are shown by thick gray horizontal lines. Thin gray lines show how the unexplained portions are updated assuming that C is the optimal explaining interval for the set.
Figure 7B:
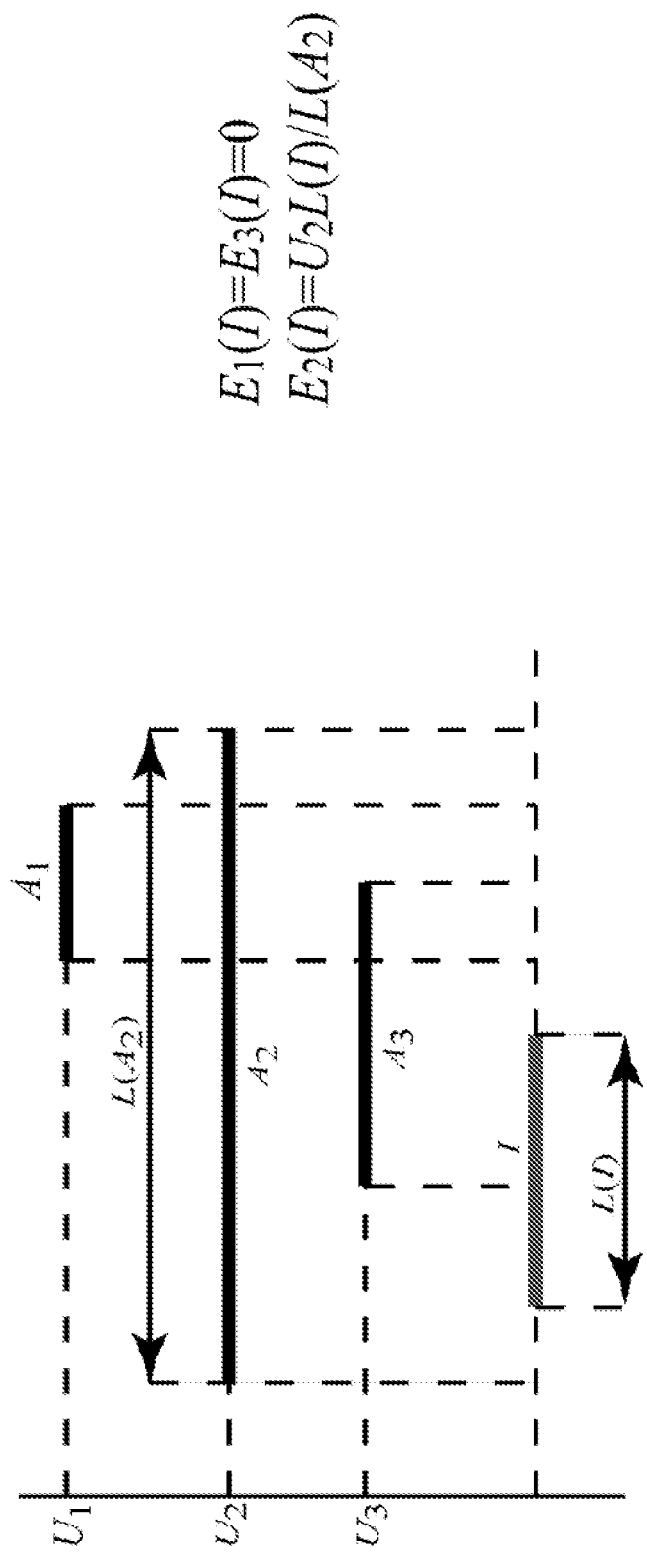
Figure 7C:
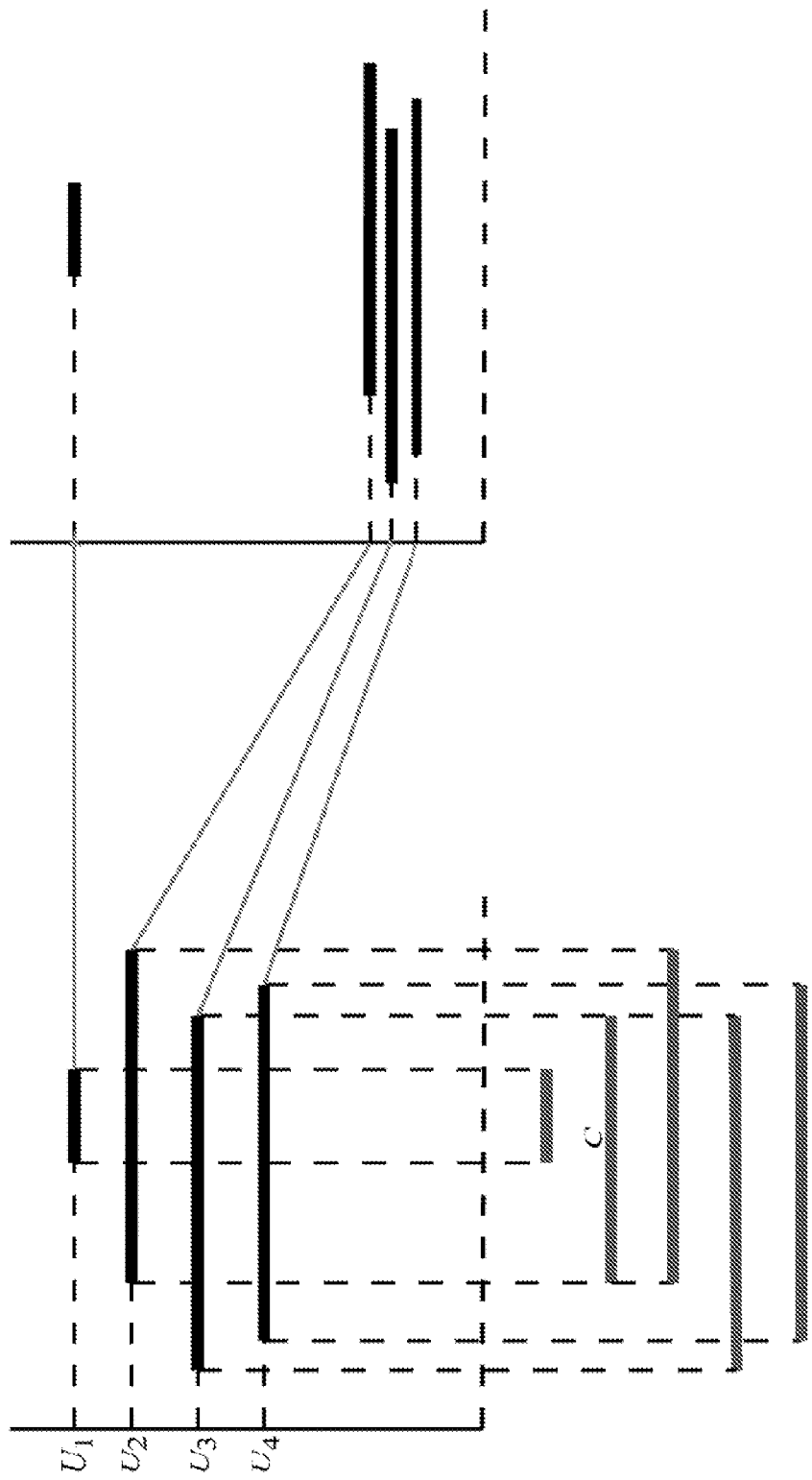
Figure 8:
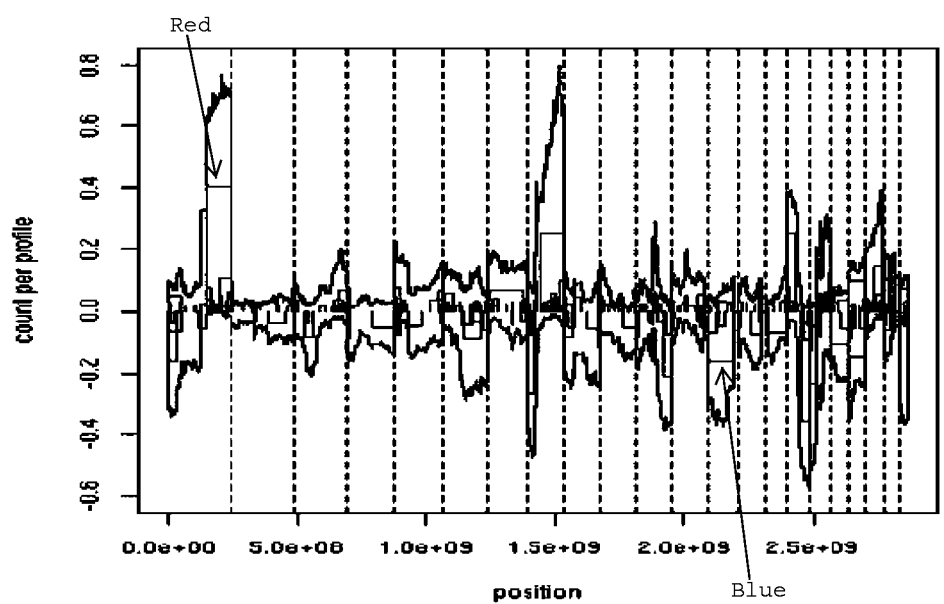
FIG. 8. Amplification and deletion consistently recurrent loci (CRLs) derived from a set of 257 breast tumor copy number profiles are shown at their genomic positions. The height (depth) of each CRL is its score per profile. Position-dependent amplification and deletion event counts per profile are shown for comparison. Chromosome boundaries are indicated by dashed verticals.

Kaplan-Maeier style curves for plotting survival (FIGS. 1-3) were obtained using the "survfit" and "survplot" functions in the statistical package that comes standard in the S-plus 2000 mathematical analysis software (sold by MathSoft, Inc.). Mulitvariate and univariate analysis of marker combinations was performed with the S-plus 2000 package or the freeware package known as "R".

Example 4

Results

Whole genome copy number data obtained using comparative genomic hybridization (CGH) was used for two purposes. The first analysis was to show that a microarray copy number procedure could yield results comparable to FISH for the purpose of determining the amplification status of the ERBB2 gene locus itself. Although both FISH and CGH both yield some false positives or false negatives when compared directly (FIG. 1A), the survival and recurrence curves for the two assays are statistically indistinguishable when used to determine which patient should receive trastuzumab (Herceptin®) (FIG. 2B). This shows that CGH by itself could be used as a predictive marker for success in trastuzumab therapy in Stage 4 breast cancer patients.

Secondly, a specific set of CGH values from the Her2 locus as well as certain locations in the genome not linked in any way to Her2 can be used in combination with the Her2 amplification value to identify a subset of patients, not previously anticipated to respond to trastuzumab (that is, those with low levels of Her2 mRNA and no amplification at the ERBB2 genetic locus) do, in fact, respond to trastuzumab in a statistically significant manner.

This is a targeted approach based on examination of frequency plots of subpopulations of this cohort to identify 10 potential regions that might affect trastuzumab sensitivity, rather than a whole genome based study. Therefore the correction for multiple testing (Bonfaroni correction) is limited to less than one log 10.

Univariate analysis of these markers yields the following hazard ratios. Those in numbers 4 and 5 are comparable to the treatment benefit of patients with ERBB2 amplification.

1. There is a significant benefit of trastuzumab treatment in the entire cohort. The non-treatment hazard is 1.504, meaning that the non-treated patients are 1.504 many times likely to fail within a month from now provided that they have survived till now.
2. For those with ERBB2 amplification using either the CGH or FISH threshold there is more benefit from treatment: the non-treatment hazard is 2.09.

An amplification at marker B: A ratio of 1.1 or greater (when compared to a known diploid reference genome) for any genomic location bounded by the following chromosomal positions on human chromosome 4q (defined by the reference genome in the UCSC genome browser reflecting freeze HG18):

Position 169.81 mb-185.239 mb on 4q. The genomic location bounded by position 169.81 mb-185.239 mb on human chromosome 4q (beginning at 4q169.81 and ending at 4q185.239) as defined by the reference genome in the UCSC genome browser reflecting freeze HG18 is set forth in SEQ ID NO:1.

The reference genome referred to as freeze HG18 is the March 2006 human reference sequence (NCBI Build 36.1) which was produced by the International Human Genome Sequencing Consortium (Nature. (2001) February 15; 409 (6822):860-921; Kuhn et al., "The UCSC Genome Browser database: update 2007." Nucleic Acids Res. (2007) January; 35(Database issue):D668-D673; Fujita et al., "The UCSC Genome Browser database: update 2011." Nucleic Acids Res. (2011) 39 (suppl 1): D876-D882.) The HG18 reference genome data is publicly available at: genome.ucsc.edu/cgi-bin/hgGateway?db=hg18

Table 1 shows the chromosomal coordinates for ErbB2 and markers B, D1, and D2, in addition to the P-values obtained when patients positive for deletion at marker D1, deletion at marker D2, and amplification at marker B were treated with trastuzumab. The number of patients affected and hazard ratios are also displayed.

TABLE 1

| Marker | Central Probe | Chrom | Chrompos. Center (Mb) | Chrompos Start (Mb) | Chrompos End (Mb) | P value | Patients affected | Hazard Ratio |
|---|---|---|---|---|---|---|---|---|
| ERBB2 | 194854 | 17q | 35.16 | 34.89 | 35.25 | 0.003 | | 2.09 |
| D1 | 195350 | 17q | 38.54 | 35.42 | 56.76 | 0.00048 | 30/206 | 2.457 |
| D2 | 194554 | 17q | 33.461 | 32.010 | 34.215 | $4 \times 10^{-6}$ | 33/206 | 2.7 |
| B | 66000 | 5q | 176.587 | 169.81 | 185.239 | 0.029 | 28/206 | 1.79 |

3. For those with no ERBB2 amplification the benefit from treatment is not significant.
4. For those with no ERBB2 amplification but with a deletion at probe 195350 (Marker D1) the non-treatment hazard is 2.457.
5. For those with no ERBB2 amplification and no deletion at probe 66000 (Marker B) the non-treatment hazard is 1.793.

These predictive markers, obtained from CGH data, can be defined as follows:

A deletion at marker D1: A CGH ratio (when compared to a known diploid reference genome) of 0.85 or less for any genomic location bounded by the following chromosomal positions (in megabasepairs) on human chromosome 17q (defined by the reference genome in the UCSC genome browser reflecting freeze HG18):

Position 36.100 mb-38.6 mb on 17q

A deletion at marker D2: A ratio (when compared to a known diploid reference genome) of 0.85 or less for any genomic location bounded by the following chromosomal positions on human chromosome 17q (defined by the reference genome in the UCSC genome browser reflecting freeze HG18):

Position 33.361 mb-33.8 mb on 17q

Example 5

FOCAL

Methods 226 copy number profiles were obtained as described in Example 3. Single-profile pre-processing included normalization, segmentation, and identification of significantly aberrant segments (amplification and deletion events). Candidate markers were identified using the FOCAL (Finder of Consistently Aberrant Loci) algorithm, defined for amplifications as follows. The definition for deletion is completely analogous.

FOCAL is a computational and statistical method for identifying regions of recurrent and consistent DNA copy number alteration in a set of multiple copy number profiles. The input into FOCAL is a joint set of N copy number events $A_j$, j=1, ..., N of a given sign (either amplifications or deletions) from all the profiles. Each event is associated with a specific interval of the genome and an additional attribute, a real number $U_j$, $0 \leq U_j \leq 1$, which is called the unexplained portion. Initially $U_j$ is set to 1 for all j. i.e., the events are considered completely unexplained. The algorithm examines genomic regions (intervals) for their ability to explain events as follows. For an event $A_j$ and an interval I the explanation $E_j(I)$ of $A_j$ by I is defined as $U_j L(I)/L(A_j)$ if I is contained in $A_j$ and as 0 otherwise, where, for any interval I. L(I) is its length. The explanation of the set of events by I is then computed by summing over the explanations of individual events: $E(I)=\Sigma_j E_j(I)$. FOCAL iteratively searches the genome for optimal explaining intervals. The iteration loop consists of two steps.

1. Compute the optimal explanation $S=\max_I E(I)$ of the event set and the corresponding optimal explaining interval $C=\text{argmax}_I E(I)$. These are called the FOCAL score and the FOCAL core, respectively.
2. Update the unexplained portions of the events by subtracting the explanations provided by C: $U_j \leftarrow U_j - E_j(C)$ for all $j=1, \ldots, N$.

It is evident that the optimal explaining interval is found among all possible non-empty intersections of events: for any interval I $E(I) \leq E(\Im)$, where $\Im$ is the intersection of all events in which I is contained.

Executing the main FOCAL loop results in a series of cores with scores in a decreasing order. Next, cores are selected whose scores are statistically significant and whose boundaries are robust against variations of the input data. The score significance is determined by empirically testing the null hypothesis that the observed kth FOCAL score is not improbable in a set of copy number profiles, each generated from an original profile by randomly placing its events in the genome. If K+1 is the smallest k for which the null hypothesis cannot be rejected, the first K cores are retained.

Robust cores are selected by applying FOCAL to multiple bootstrap samples of the original set of profiles. The first K cores are computed for each sample. These are matched to the original K cores. The degree of matching is quantified by the Jaccard index of the two intervals: $J_{CC'}=L(C \cap C')/L(C \cup C')$. These indices form a K×K matrix J. Matches are required to be mutually optimal: an original core C and a bootstrap-generated core C' are considered a match if $J_{CC'}$ is maximal in its respective column and row of J. If such mutually optimal matching can be found for an original core C and a bootstrap sample B, the corresponding $J_{CC'}$ is taken to be the matching score of C for B: $M_B(C)=\max_{C'} J_{CC'}$. Otherwise we set $M_B(C)=0$. Finally, a threshold T is introduced, $0 \leq T \leq 1$, and the reproducibility score of core C is defined as the fraction of bootstrap samples B in which $M_B(C)$ exceeds T.

It was determined that the first K=250 cores for each sign of aberration (amplification or deletion) are statistically significant at p=0.001 level. In view of growing computational cost computation beyond K=250 was not pursued. We then set T=0.6 and retained 188 amplification and 177 deletion cores whose reproducibility scores were above 0.75. All these were found among the first 226 amplification and 232 deletion cores. The number of retained cores is therefore limited by reproducibility rather than by significance.

Results

Twenty two markers were identified such that HER-negative, marker-positive subset contained no less than 10 profiles of trastuzumab-treated patients and no less than 10 profiles of trastuzumab-untreated patients.

Log-rank test for the effect of trastuzumab on overall survival was performed in each of the marker-positive, HER2-negative subsets. Hypothesis multiplicity was accounted for by estimating the false-discovery rate through a permutation test: each of the observed time-status-treatment triples of variables was assigned to a profile at random with no replacement. 1000 permutations were generated.

The top two markers (false discovery rate was estimated at 0.054) were identified as a loss of chromosome 18 (marker D3) and a broad deletion in chromosome 17 (marker D31). For these two markers the benefit was shown to be marker-specific: hazard ratios for trastuzumab were found to be significantly higher in the deletion-positive. HER2-negative subset than in the deletion-negative. HER2-negative subset in each case.

Deletions at markers D3 and D31 can be defined as follows:

Deletion at marker D3: A CGH ratio (when compared to a known diploid reference genome) of 0.85 or less for any genomic location bounded by the following chromosomal positions on human chromosome 18q (defined by the reference genome in the UCSC genome browser reflecting freeze HG18):

Position 2569041604-2644838637

Deletion at marker D31: A ratio (when compared to a known diploid reference genome) of 0.85 or less for any genomic location bounded by the following chromosomal positions on human chromosome 17q (defined by the reference genome in the UCSC genome browser reflecting freeze HG18):

Position 2491569515-2536157424

TABLE 2

| Marker | Chrom | Chrompos Start | Chrompos End | HR+ | Coxp+ | LRp+ | FDR+ | HR− | Coxp− | LRp− | p+− |
|---|---|---|---|---|---|---|---|---|---|---|---|
| D3 | 18 | 309355 | 76106388 | 6.37 | .0012 | .00028 | 0.054 | 2.60 | .094 | .092 | .008 |
| D31 | 17 | 1612008 | 46199917 | 5.00 | .00073 | .00021 | .091 | 1.42 | 0.15 | 0.15 | .009 |

Legend:
HR+, Coxp+, LRp+, FDR+ - univariate Cox hazard ratio, Cox regression p-value, log-rank p-value and false discovery rate in the deletion-positive subset;
HR−, Coxp−, LRp−, FDR− - univariate Cox hazard ratio, Cox regression p-value and log-rank p-value in the deletion-negative subset;
p+− - p-value for the difference in the hazard ratios between the two subsets.

In the case of marker D3 a two-variable Cox regression for trastuzumab treatment (T) and estrogen receptor status (ER) finds both covariates to be significant. Likewise, a two-variable Cox regression for T and progesteron receptor status (PGR) finds both covariates to be significant. However, only T retains significance in a three-variable Cox regression for T, ER and PGR. In the case of marker D31 basal expression subtype indicator (B) is found to be a significant covariate, and the effect of T is stronger when adjusted for B. No other covariates were found to be significant in each case.

TABLE 3 adjustment for covariates

| marker | covariate | HR (T) | p (T) | HR (covariate) | p (covariate) | Log-rank p |
|---|---|---|---|---|---|---|
| D3 | ER | 4.44 | .0097 | 3.41 | .033 | 7e-05 |
| D3 | PGR | 3.77 | .029 | 3.51 | .039 | 5.9e-05 |
| D31 | B | 5.091 | .00068 | 0.395 | .021 | 6.3e-05 |

Both marker D3 and marker D31 contain narrower deletion markers that do not meet the criterion of there being at least 10 profiles for each value of T. However, once marker D3 and marker D31 have been identified as significant, the narrower markers may be considered in a logical OR combination with their respective parent markers. The effect of T on survival is enhanced if a deletion at marker D3 is combined with a deletion at marker D57 and if a deletion marker D31 is combined with a deletion at marker D58.

Deletions at markers D57 and D58 are defined as follows:

Deletion at marker D57: A ratio (when compared to a known diploid reference genome) of 0.85 or less for any genomic location bounded by the following chromosomal positions on human chromosome 18q (defined by the reference genome in the UCSC genome browser reflecting freeze HG18):

Position 2613556418-2644838637

Deletion at marker D58: A ratio (when compared to a known diploid reference genome) of 0.85 or less for any genomic location bounded by the following chromosomal positions on human chromosome 17q (defined by the reference genome in the UCSC genome browser reflecting freeze HG18):

Position 2526115306-2531562878

Additional markers D11, D26, A1, and A73 were identified using FOCAL. Deletions or amplifications at the markers are defined as follows:

A deletion at marker D11: A ratio (when compared to a known diploid reference genome) of 0.85 or less for any genomic location bounded by the following chromosomal positions on human chromosome 15q (defined by the reference genome in the UCSC genome browser reflecting freeze HG18):

Position 2321235462-2388879211

A deletion at marker D26: A ratio (when compared to a known diploid reference genome) of 0.85 or less for any genomic location bounded by the following chromosomal positions on human chromosome 8q (defined by the reference genome in the UCSC genome browser reflecting freeze HG18):

Position 1394335322-1422565813

An amplification at marker A1: A ratio of 1.1 or greater (when compared to a known diploid reference genome) for any genomic location bounded by the following chromosomal positions on human chromosome 11 (defined by the reference genome in the UCSC genome browser reflecting freeze HG18):

Position 1819233296-1819244477

An amplification at marker A73: A ratio of 1.1 or greater (when compared to a known diploid reference genome) for any genomic location bounded by the following chromosomal positions on human chromosome 11 (defined by the reference genome in the UCSC genome browser reflecting freeze HG18):

Position 1819233296-1819234328

TABLE 3

Markers identified using the FOCAL algorithm. HG18) genomic coordinates and chromosomal positions are given for each marker.

| Marker | Chromosome | HG18) start | HG18) end | Chromosome position start | Chromosome position end |
|---|---|---|---|---|---|
| D3 | 18 | 2569041604 | 2644838637 | 309355 | 76106388 |
| D11 | 15 | 2321235462 | 2388879211 | 20444124 | 88087873 |
| D26 | 8 | 1394335322 | 1422565813 | 2780282 | 31010773 |
| D31 | 17 | 2491569515 | 2536157424 | 1612008 | 46199917 |
| D57 | 18 | 2613556418 | 2644838637 | 44824169 | 76106388 |
| D58 | 17 | 2526115306 | 2531562878 | 36157799 | 41605371 |
| A1 | 11 | 1819233296 | 1819244477 | 5755441 | 5766622 |
| A73 | 11 | 1819233296 | 1819234328 | 5755441 | 5756473 |

Example 6

Materials and Methods 12-18 yo primary tumor blocks from 238 patients on CALGB 9840 and CALGB 9342 (sample size 710).

DNA and RNA extracted from 1.5 mm punch cores using the Ambion Recover-All Nucleic Acid Kit™. (Harris Lab)

Nucleic acid purity, quality and quantity measured by:
spectrophotometric analysis
Bioanalyzer RNA Integrity Number (RIN)
threshold cycle values of housekeeping genes (RPL13A and Actin).

successful extraction, amplification and hybridization of 210/238 DASL arrays.

Date of receipt of FFPE punch core, age of sample (eg. diagnosis 1995), study source (eg. 9342, 9840), processing technician, and reagent batch not associated with assay failure.

260/280 ratio was outside of the expectant range in 18/28 (64%) of the tailed cases, compared with 92/238 (39%) of the entire cohort.

28/238 (11.8%) failure rate on these archived, formalin-fixed, paraffin-embedded breast tumors, range in age from 12-18 years.

50% of failed cases also failed FISH

Methods—CGH (Hicks Lab)

237 samples supplied from CALGB
FFPE DNA prep Ambion Recover-All Nucleic Acid Kit™
50-100 ug DNA amplified by WGA (Sigma)
CGH on Agilent 244K arrays (205/237 pass QC)
189 with usable CGH and complete clinical Info
Segmentation using cbs segmentlon (Olshen, 2004)
KM and Epicenter Calculations done on segmented values

SEQUENCE LISTING (1 sequence)

SEQ ID NO: 1 - DNA, 15429001 bp, Homo sapiens (residues 1-2,204,143 of 15,429,001)
aaatggaggaaggggtgggatattcaggaaactaccaaaatatgtacatgtgaaaataaatttcatgaaactgattctttggttaaatagcgttttaaaaatctcttcaaagctctcaaatgggcctttgaaaaattaaattacaccacattggatctgaatttagcatgtaattttctaacacatttttatttttttattttttatatgtttttaattatactttaagttctagggtacatgtgcacaacgtgcaggttaacacaaacattttaaagttagaggttctacgtcaatgaaataaggctaaaacatgaaccttgggaagaaacattggaaactttagtacaaaggaagttacgaatgaatatgattaagtttagaaagctttcctaggagaggaaatgtgagatgttgattcaggttttcgttcaaagaatgaaagcattatttaaaatatattttgtgatgcaaacagggaaacatcatagtatttttgtgtgtgtgtgctgaatctaagctccattttacagctagtgtgtccccaataaaccatcctaattagaaagcccctggaaatctccagcattatcttaattaaattagcctaatctaataaatgcatcataattaagaggactgtgccattctttagtgttcagcacaccaggcattagatgatttgtcccactttcagccgtcagttgtcatgcttgctaaaagaaaagaaaaatgatagcaccagtcatcgtagtccctcaaggaatcatccatctagttcttgaattttctttacaacacctctgtcaattatttcttcctcttcagagcatctagtgacagggaactcactaagccattttgatctatttcatctttgaacatatggaataattttagccataagaaacctcagggaattttttttaattccttcaacatagacctaacatagtacccagacaactatttttacgtccaatttcaaacaacctggaaaaacagcggatcagtggaacactaaaggctatagggagactatgatcattcttgcccaaaggaattgcaaaaaggcaggtgtgtaaatagtatttacatataggatggacctctccacctttttctagtacagattaatttttaattttcccaacatctataaattgccagaatggtaaggtagtggggaaacactttctcacaatgtacacagacttgaaagctgttgacctgtcctccttatgacagacagttcttggcaaccccaaggagagatatggctgaggcagaaatcacattatctagctcttcggctatacacatattgggctctgataattagaacattgatccacaagacaacctttgagtatgctgttcttttccttcacagcaaacacgtatagtcattatcgtttgcttgtttgtttgtttgtttctttctttctttcttttttgagacagagtctcatctggagactcccaggctggagtgcagctcactgcaacctctgcctcccgggttcacgccattctcctgcctcagccttctgagtagctgggactacaggcacccgccaccatgcccagctaatttttcgtatttttagtagagacagggtttcaccatgttagccaggatggtctcgatctcctgacctcatgatccgcccacctcgacctcccaaagtgctgagattacaggcatgagatcagttattttttttttaagacacagagtctcactgtgttgcccaggctggcttcaaactcctgggctcaagcaatccttcaacctcagccttctaagtagctgggactacacatggctcatcagtgataattttaaacacaaaaatacacatttttatttgcttatgcaaacaaaggaacgattataatttcctgcaactagtaaatatcatatgctaaatcctttttttctaattccacctcttccccaccacaccatgtaatagctttagagttgttttttttggggaggagggaaggggtgttatgtgtatttttttgtcttttgccaagtctctaagtgcctctgaagccaatttttaaaagttgtgcattgtgagatcacagttgctttagggcatacaggatataagcacaaaatgatggactgtagccaggtagtgaggctctaattgtgtcagaaagaagaacattttcatcatgacataacgaaaactgtatttttcaaagaaaaagatctaaatctgtatcaagtgataacattagttttcctacttttaaaaacaaaatctagtctattattaatagaatgaaatgtcagccttaggcaatttgctgtgaaaaaccaactgaaatgaaacatggcattttattcgttattcaaatggccaaataaaacaaggtgtaattagtcctgacttcctgttcttgctcacacacctgaggcccctccccgctctgctgcagctctgcataaccaggctctcaggggaagcagtggaggcagccttcttggacaacagctcacttgtctacacagtcaaaagtatgtatttgatcaaaatggttgggaggaggacaggtgttacttagagaattacctgtgtaactagaacaagaaaaggaggcagcatttgcagaatgtttgcaaatctttcaggaacttgattcaaggagtgtgtcagatgttaaatccaggcatatatgtatatggctacttgtgtgtgtgtgtgtgtgtgtaatagtgtaatttcacttttttaaaaaatgaagacattcacaattttagccagaatagttggtgcaaggtccataagtgctacctgctaagaatataattccttctacctctaatgtttcattatcaaattaaaagagttctctcctcagtggatacttcatttatcatagctctccttggaaagctgacctctaaacatgaacttctagaaggaacacagaataagaacaagggaaaagcattcgggaaggagggtggctttgaaaggagttagctgggaaaacccttgaaaaagaaagtgaatccatttctgtacatacaattattgactgacggggcagtttacagttttaagttcgtgtgcactcatgccctgtttgagatgcctgttttgtggttcctcagagaccacactagccacatttgaacaccattagattagactagagccaggactctgcaaagggaggctcttcctcagcctctgacagaatcaccaccaaatctggctgtcctccttgccctgagcaattgaacttggctctgtggagggagcctcaaccaactgaagcatcatttggagaacagatgaaaaataaagaagcgaagccttttgaattctaaagttttagctttttccaaaagtaaggcattttcctctcattctcaatctcttcttccattcagttttctcctcccatattcttagtcgtgattacatagattaaggcaaggaactgggggtttcactaatgaactcggggaaattttgagggacatctcctgtcctttgactttggggaaagttcttccattgctaaggaaaaaagttgtattggatgtaattgtttgttaaatgcaaagaactaactgctgggcattctaggagtccgtacatgaactgttttacgtgggtttctgcaattccatagagtcgaagacaccaataggagctgtggcccctttgcctagtttgactttagtcctttggagtttcataattctgaggggatcattgtatttcagtggacaggttccaaatgcacagaagactgacagcattgtctgataaagcatctcccattttatcccatttggaatgtaatccaagttacaacaatagctaataattacctgctgtaattgtagcaacagaatagctgaatgtgcacctctagctgatttatgtatgcaatttctcattctcagctctctataatccattctccacccccccaccccccacccccaacgctttggagccttgaaagcattcaatacaaattttcacaatgtaggtaactttgaagtgtggcttgtcaggtcatgctgacttatttttgtacttgcatagggaattggtgaggatgaatctatttttttagctaacaagtgtaacttgagaatttgtgaatgagtgacagatggggtgggaacctttttttccttcacgtattgtgaaatgtactcctgtctactcatgggaatgagtcacatttgcaaaaagccataatattcattagtgccaaaacgacattttttagttgctcttgcaatgagctgtaagtaggacaactgcccatcctagtttacccgaaacagttattatttattcctataattatcaatggttacctatttatttcatcctcagaaatgtcccggcttgggcaatatatgtttaccctgcatatccagattgtggggggaaatccagtattttcatgtgccatgcccaaatggcagcttatttaaaaaaacagaaaattcttggaattaacggtcaaggatacgtgagagattagaaatcaacatttcacattaattcctgtgtaagaaaattatacgtaaacatagactgttaaaacaggcatagcaaatatgtttcaactcaggggccaacactaattggttggtagtggctgcccctagcatcactggagaaggactctgaaaccgagttggggatcaatgggatatagggcttgccgtattactgatgtctgccataagctctggaaaagctagttgtaaaatgtatgctaggtattaaatgtcaccaccatagagccagatgaggttttagtgataatccaacccagtgttttcaaaatgtgttcccagaacactgatccttcaacatgattcacagaacacatgttccatggtccagtaagattgagaatgatgcctgccatatttctctctcagaaattcagtgtatattggcacagagctctaaaaagttctgtttaactttctgacagatgtttaactttgtttaacccagtgcttggtaaacctatttggccacagaaaccttttcaatgttatctgtcaacttgctacagaactagtttcttggtacacatttgaggaaactctagtcttagcccattccttgcatttcacgaataaggaaactataaccccaaatgagagactgactggaccacagtcaacttagttgatctatggaccaggcaaaactggaactcagtgatataagagttaagaagaaattatttaggcagatagtgagggtataggagtccttggtaaggttttccttttaatgaaaagcagccccaaaattatactaacgagcagcctgtaaaattgagctgcagacacagacaagcaagcgggaagcttgcatgggtgaatgccagcagttgtgccaataggaacaggcacctgagactaggcatgttcaaaatggcagctccaccttcccttttctttgccagccacatgtacagtaaggagcagatgacatgggctagccaagtggaaagcccatttgcataataagattagggtggggtggccagccttcccaaaacgtcacacctggtccaaccaatctgtgggccctacgtaaatcggacaccaccacctcaaacctgcctataaaatccagtgcactcccattcgggagcccctctgtctcaaaaaaagagagagagctgttctcctttatctttctttcgcctattaaacctttgcttctaaacccactccttgtgtgtgtccatgtccttcatctttttggtgcaaaacaacgacgaaccccaggtatttaccccagacaatgaggctgcttcatcagaactgctgactccaagtcctaggtcctttccactgcatcaacaatgaggaaaatattagaagcaatctaagattttaatagcttctggcagcacagatatttagtagatttcacttatctatttttataggttttggttttttgttggtggtgggtttttatttggtttttttttttttttttgtgatgagatcttgctttgtcactcaggctagagtgcagtggcacaatcatagctcactgctgcctcgaattcctgggctcaagtgatcctcccacctcagcctcctgagtacctgggactactgacacgtgccaccatgcccagttagttttcaaattttttttgtagagacagggtcttgtcatcttgcccagactggtctctaactcctgggctgaagtgatccttccaccttggcctcctaaagtgctgggattataggcgtgagccaccatgcccagcctgtatttgtttttaaaagatggtaaataaatatctgtatattcctagtgtcagacactaagctacctctcatggtcaaaaagaaaaaaaaaaggcaagataaaatcatttttgtagttgagttttatctgggctggtccatccttctattttatcctttttccttaggagataaagtggttatttgaggaaagacttgctagacatgaatctggttttggttcaaattctattttattatttcctgggctttgaatttcaaaaagccaatctatttattggtctctttggggccataaggttaaagtacatctgttgtccacacaaatttagctattggccttcgagctaagcagtcatgaaattatagccatagtaaatttagacaacgattaatttcacttcggtctgcctataagtccacatgacagaataaacatagtgtgtcatgtggttaatgtgaacacatgtaaaaaattaagaaatctttggtgaccagacaaaaaatactccataaaaattaattagtgtttcattgtggatgtatgaaatgcaatacttatagatggcctgacttggagcttaggcagcaacaaaacttatcttgggcatcactttcaaatttcgttttggtggttctccagttcgtggcagaccactgccattcctttgaggaaaaggaacacctggaaaatataaccattgctgaagcacttatctctctggggttttttcctaccctttattttcattattataccattacagaaactggttgcttcagttttcttcaagtatggacttcatgaagccatgtggttgcatgtgctttgggaggaggaggcagctgggggctaaatttgccatcctgaaatcacccgtgacatccctttgaagatacattttgtcaggaagcacaaatcagtgaagttgtgaggaagaaatggagagacatctttcaacataaccttgtttccccttgagcataaaggaattgatttaaaggagaaaataaagactcaacagtttttaaaggcttttatttaataagcacctgattgtttccattaactggcttttaacatttaccattttgcttagcaaagttggagaacattagccaagattcactgatgaaactttataagcgttataagtcagatttgtttcattttaaaagccacatgtttaaaatacagtgcacagagaattttcatgatacgtagttgtggttcaataaaataaagatagccaaaagaaactgtcactcataaaatctatatttcctgctaagtgttagtattaaaatagatactgctagtcaacttgtaagccaagcaatgccatatgtgattttttaacataagctatttgtagtctatactagaaagtgtatcttagactttgcagtgatttgttggttcctttcattaatcatgaatttattatcataaaaatcaacacccatgaccctatcttggagaatcggagtgttctgagcattcccagatgtgtactgcagctccagtatacagttcagagccccactgccagttgccaggatcacaagagaaagatattagtagaccacgtcagggaggtgaatttttaaatgttcttacaccacccaagaatggaagtgactggtggttttcaaggacagccatttggtctgaagcagctgcagccccttgattttaattatcctcctgaccctttgatccctaaccaaaaaggccctaggactgtggacagatgcagccactctcctttaacaactggactcagaccaagtcagcagtcacatttaacctcaccttgaaatgtagaaagtgaacaattacatattgaacattttcatgtaaaacatcttcttgaatttcaatccagccacatcctgctagtgcgataatgtgatccttgaatttttggcaccatctaatttttaagctggaatgtttggaaaatccttacggggagggaggaatcattatgcaacaacaacaatacacacacacacacacatatgtatgtgtacgtatacatatttataaaaaacaatttcaaaatcccagcacagaatagtataaagaaatatgccatcttacagaactataatgttacaatcctttttccttttatgtactataatcctttatgaacaaggaaaattcaatactggagaatattatctcctctccaacaaattgacttcaacttgagtattatatccaaagaaacttaatctgtaagtatgaagctatacccaactttgaaagatttttgaagcagtacaagtttctttcttcttcctcttttttttttttccttttttttgagacagagtctcgctctgtcacccaggctggagtgcagtggcacgatcttgactcactgcaaccttcacctcccgggttcacgccattctcctgcctcagcctcctgagtagctgggactacaggcatgcaccaccatgcccggctaatttttgtatttttagtagagacggggtttcaccatgctggccaggctggtcttgcttgaactcctgaccttgtgatctgcccgcctcggcctcccaaagtgctgggattacaggcttgagccaccatgcctggtgcaatacaggtttctatgtgatggaaaaatctaagctcattaggtaaaatatagtcattgtatttccttatgtctacaattggattttcttctccgttagcccctgctactagtctcatgaactaagaaacctggcttagctgacatctatgcttccagtcgattcctgcattgcggttgaagtgaaaaaagccccttgatgaatgaatgaataattgattgatgaatgaatgaatgaatgagtatgactagatcttctaatccttttacattttatttccaattagtacaaggtaattttcatacgctgtttatggtcttgaaatctgacagccagtcccaactggtttattcttatattagcaacttaattcttttgaaggggcatgtaccatgcccactaattttgcaaggtttggctctccagtttccctcagctccttgtttgtgtggcaattacatagctatttaacagctgcactagaaattaaagaggaagaatcagtaggctttgttaaaacatgtgtctatccatagatacatgttttgatgaaagatgaaagccaaaagcattaaggaaaatgaaattttggagactacgtggtttttattgtttgtgttcttatttttaattgctatagataaatgagagttgctgtatctaaaaatataatgacaactacttcacaaggtacttgtgaaaataaaataaggtcatatttgcatataatatgcattcaataaatattctctttcccttaatttgaatttttataagtccttaagaattgtcattgttcccaaatattgtatgatctttccatcctaattatgagatcataattacatatttttatgattttatggcagaaaataaaaaatgtgattgaagttgaaatttatcagaagttcagaatgggaatgtagataataagattttaattttttgatatgctacccagatactattcactagataaaaggcttccaggtattcaaaatggaatgaataaatgtccgagggggttctcaagtcaaattttacttgagtggattctctcttagccacattccacccacactcctctctcaatcaaaacccctctccactcttagcccatagcaattaaacagggctttcaggatctggaggaaagtgagaatgtatcccctagaaagagatcaaattgaggatggcaaatgtgtttcatttcagccttcaactttagttgctttgtagccttaaacagctgtgctgaggattctcagacattctgtctcactagcaaagaacattctgatgagtgagtgatgtctgccacaggaagaagggggatagtgtccttgcctgtgccatgcatttaccaaacctatacttcatcctattttgtatgtttcactgtttagcttgtcaccctagtatctctttccctaaatgataccagcaacaagaatttaatgtgagagaaatttcaagaggtcaaaatttaaccaacagatctcctcccatttacctctttagagaatagtaaatgttttgagttctttgccaggaagctggtggaattatgacctttgagaaactgaactaaacaaacatgactgtagcacacccatctcgtccaatgtgtggtgccaaacttcaaaactctaagattctgttagtttagacaagaaggtgatgcatctttaatcagctacatgaagagtggatgaggcagatttccttttctcatatatgcactaactagattattttcagtttaattttatgctttttaaatgcacttcagtttgagttggtgaaagtctataagcctctctccatatatattttaaagcacaaactgtggccgatattaaactatttgttcagtcctttcttcatctgtaagcatattcttctttgataagctcaatggcaatgtgccctgtttgaaaatgtaggtttgactgctattcggatgtggtgaggtcaacagattaggagatgactgtcattggaaagatactaaatagtttgttattcatagttcccaagaggagggggcatgccacaccacaggggactgcaggggacgtgccagggtcagtcagaaggccaaggagcaagggggaaatgtggacaggtgcctttgcctaggaacccacaggaaagggataggtgaggcaaggtacgcagggttagaactgcctgttttgagtaattccagtgggttctcaagcacaggggctgtttctggttgtctggtatctggccctgggttgatgtggggagggaagttgtggccctgagtatgagagcccaatagagggggtgcagagtgtgtgggctctggactggttagtttgcatatggagggcatgctcccaggagggtctttaacacctctaggaactggctaaccctgggatgggcagtccctgcagggtcagcaatgtcctagatgcaaaattgaatgcatgcaaaattatgttctttttgtatgtttctctctgtactcaaaaataattaacctcattcatttgataattgatcatttgtccctttctgatatcgtctgtattgtttcctcatgccattatttgatatcaaatgtatttatgccaatttccccaactagaaatcaactacttcttgattgtttaaaaaaaatgcaatttttaacttttaaaattgatccatagagtattgaacatagttgatgctttaaaatatttattatcagccccacattactttagaacatgcatccgatgaaataacaaatagtgaagaaatctgtgctctaatagatttgtaaaatgctacatacatattacatctccctccttgatgtttgcaattcacatttccttatttaaggccctgggaaggcctgcagcaaagaaatttgtttaacgttgtctcaatccagccatttactaaacttatttgaccatgaaattttttctcattgagtacctgctaacaacccgtgaatatgttgcagaatgcttttctgtactgtttcttccatggaatttgtactttaaaaaaataaattaagactgattataaactgagtgatgatgagtttaaggctaaagaaaataatcagtaagtgctataaagtgcttgaaatataccttaatactggcagaaaagttaagacaatgaatgcattttctgcctcagtctaactcatctatttagtcatctgaaatggctcattatgtaataaaactcttcagcaaccgcatatggcaaaatgattggtgcttgtaaaccactaggctgacctgtttttgctttttaaatatgcatgttttttgttctccacctcagtgaataaaattgaaacagcatctcagattgtaatacataggagaaataatgcagagaaaagaataaatttgcccagtaaggtataagtaaaataattagcatgagccatgcatattgctttcagggaaagcaactgacagccagggaaagtcagttattgacgtaagtgcctgtcaagtcaccagttctatgttgttaaaatgtggtaagttagggtgtgacccaagaggaggaggaaaaaaaaaaaaaaaaaaccctgcaaatattttgatggcaggctctccctaaaaacaaaaagggcagcatagtttctggccagtatttagatcagtgtgtgtttgatctatgattggaatcatttgctcaatggaactagcaatggcagagcaaagaggctcaactgtgactttaggaaagtcattgagccttccagttcaggttcctcatctgtatgaagagacaaaatgtcaagggttttttgttaaatggaagagtgtatttttaatgattgtgttaaaaaatatttcacaaaatgatgtagaaaattctttgatgaagggtgcaagtaattaatggcttagcttacttggaatatactaggatacaatcatgtttctgagatcacaggcccacactggacctttaaatgtattgatggatttggcaccttgtctttatcacaaccatggtacttaactttccatgttatactgaaattagctcttgatgggcctttctatcctattggaatgtaagtttttccagggtagaggcctggtcttatattaacttactctctaggttctagcacaatgtttggcatatgaatgtattaagcatgccttttaattttcagtgtctctgctgctttggcatgcgagggaccagaggtacaatatacatttttaaaaaatggttgcttgggaggttgaggcaggagaatggcatgaacccgggaggcggagcttgcagtgagctgagatcgcgccactgcactccagcctgggcgagacagcgagactccatctcaaaaacaaacaaaaaaaatggttgctatgtgaaacaagtgagcaacctggatggaaagccaagactctgtgaggcgggtcattctggtccagaacttatcagaccaacacttcttaaagtgcacatgatcacctaggggatctgaactgattcagtagatttggggtgagggtcaagatactgcacttctaacaagcttccaggtgatgctgatgctgctggcctcaggaccacactttgaggagcaaaaagcaggagtggggaatcattttctataaagatccagatactacataattggggctttgagggccatataatatgttgcaactactacttgactctgactataatgcaaaagcagacatagacaacatgtaaatgaatgagcatggttatgttccccgccccccaccaaaaaaaaaaaaccttatttaaggactccgaaatgtgaactttatgtcacaaaatactcttcttcttttgatttttttcaaacccttaaaagtataaaaaccattcttagctcaaggaccttataaaaacaggcagtaggcttgcaggctataagttcactgagttagaggacaacatactagtcacttaggtagttggcaaatgtttccctgtggagtacatctaaccaaaagaaacgaatccttctctctatggaacctctgttgcatttttttatgcttcattttcccccagtaggtggtttatatcttttttatggaatgtagaaacactctaattcacagacagactcaactagtttcagagtttagcaggcgttattttttctattacctgtagtaggtaatgcagttcctcacacatagaagaagctctgttagtgtatattcagtttattttagtctgttgaagatgcctttagcttggtcttaaggaagaatagttcctagatgggattaatgaacagggtaaggagataattccaaggagaagaaaatgtgggcacagaaaagtaggcaggtaatatttgagggctatgtaaggagcagtaagtccatgcaaatattcgacagaaacagaggattagtataagaaaacgatagggccaagttatatgaaaacccacagtgacagatctgaagtttagagaatgatgtatgtagggaaaaacctcaagggcattaatctgatgacagaatatagaaagaatttatagtctgctggtgatggagagaccaattaaaacactaaagccacagttaatactgatgggtgaggatctggactgtggctttggaaagataacagaaaaaaaagaaagagactggaggatgactctgggctggaaagttcttcaagactttatgacaacaaagaaaaccatacagtgccccagaatcaagaaatactgtcctgctccgttgcccccaaaataatatggtttgcattgcatagaatgctcagttggctgattattgtatgttctttaattccccaggtcttatctcttctttggtgggaatcacatatttactgttgagcatggtttctggggttgatactcagagtattagcaaactcatttgctttattaactttattttcaaattaaattagacaaaaacctgtattattctactctaaatacagaaaaaacatgtcttccgtgtcatatttcacaaaaggatgtgaaatccaagtaattttataggaaactggacttagagaaaatctctaagtgctcattaagagctaaatggacaatattttcccagagaattcaatccttttagttctaagtggcagatttctacatatttctttaaaaataaatcccatttggggtttttttagggcagctttgggctttgttttgttttgtttgtatgtttgtttcttggtaaaatgtaaaggccaccaaatgctactgagaatttgaggtgctgggggaagagaggagagagagtgagagaacctgtgttcaaacagtctggcagcctgaaatttcccacacgaaggacctgattgtttgggaaaggaaaagtgctgacgagcaagaatgaattacagcacaactgctatatctctccacatcttggaggccaaggcggtctgctagaaagttttgtaaatatcagaaatgtggaaggcattaaatctgttactgctcagctgatcagaagtcttaaggtcaacaaaaatattgctgcctgtgattttttaacatgatgataagtttcttttcatatattaaatattttgagcataatgtttatattttctatttttctttagataagactaatagataaaattgtaataaatggaggaggtatttgttataaagcattttataagacactgagtttctgttccttttataactgaaatggtctttctgagtttgatagcatcacttgggttgataaaatgtacaagatgctttacaaagaaaacctgtgggaattgtctagtcattaatttcacagtctaaattgtagagtttccattagtaacactgacattgttttttttttaatcaaacaaacatcattttgcatagcaaccagccttcacttctgctttattgttttaaacatcaccatttcctttctttccctcctatcctttgacctccatttggcctgcagatggttctgtgaagggaaagaactgcacaacactcctgatattcaaatccactgtgagggaggggacctccataccctgatcatagcagaggcctttgaggacgacacaggtcgctacacctgtttggctacgaatcccagcggctcagacacaacatctgctgaggtgttcattgaaggtaaggaggggtgcctggtaatgggggataaaggggtgtcaatggtctaatgactccagtatcttgggcatgcaaatgtgcctttccaatgcaaatggcacaatggtgttctaattcaaacttcatttccctgaaaacctttataaattgaactgttccgacatttaggcacccatcaactatctctgatgtcaacatttgttccttttaatgtagaatgtttccactccattaacttgaattatttaaaatgtaaggtatccaaattatttttgtctttctctagtaaatgaagcatagaaacacaattgaaataccatatcaagcaaagttaaacgataaatgactcaggaaatcattcatgagaattttaagtgattgaatactttttaatgttctcatttttactaaattctagaattttgtctcttttgttaagaccccattattccttctaaatgtattataaacttgcaatcactaggtgagaatattcaagaatcaatgttgtattaaagaggggtacgcagagaatgggctatttctgttgttctgttcatttttgacaggattcagtctccagggagttgaaaaacttgatatcaaagtattatattttacatttttattgtgttttgatcaataccaataatttagaatagttggaagtgttttaagcactgtagtgtatatactattcctaaatccataaattgatgagtgctctgttaattggttgctttcaaaataatggttaaaatatagaaagaatattaaaatccttgaggtctgtacttttttaaactatttaatagcaccaatatctccattatgtggaggtgaagaaggcaagatgtgagccaccatttatagctccttcaagaactggcccacaataattagctttaaaagtagggccaggtgaggtagctcatgcctgtaatcccagcactttgggagcccgaggcaggaggatcgctcgaggccaggagtttgagaccagactgggcaacatactgagaccctgtctcaaaaaacaaaacaaaacaaaacaaaaaaacacttttttaaagttagcctggcctggtggcgtgtacttgtactcccagctattcaggaggctgaggaggtaaggagggaggattgcttgagcccatgaggtcaaggttacattgagttatgatgataccactgccctccagcctggaagacaaagcaagaccccatctcttaaaaaaagagaaaaatttaaaaataaaaagtaacgattactgatgactaaaagtatgtacctttactttcagtgaaaggatcctccacattacctttggtagaaaacatcttggagtgcctcaagggaccttgtcctattaataaaaacaaacattctatatgtagtaacaactaatacttacatgacacttacaaaatgcacacacacacacacacacacacaatcatttatactttgccgtagcctacgaggtattattagtgttccttttttataactgaggcctggagaggtagaagaaacttgttcaaagtcacacaataatttgaaccaagacagtcttgctccagggcccatattaaccaccctatcatactgataggtatttcaaaatgctgcatgaatgaaaaatgaatgataaaaagatgtttaaaatttcactaatgagttagcagtattattcaggggtgggttatgtagcaaacttcttaagccatcttagaatacagtgaaggaaacaaacttccataaaaatcctgtctgctaatgatgatcagatgtgtctccaagttcagatagagcacttttaaatgaaattctttatttgcttgcaagattgctagaaatatgataaattttgggttgtgctgctttcatactacaaatattaaatgaaatcatattagatttaagtaaaagcctgtcaacttaatttaaccaacatttattaagatcctactaagtgccacacagtgcaggtataaatgtggttaagagacaattcctgatatcaaggagttctcaatctaacagcagataaacacatttttttaaaaaaagccgggcgcgggccgggcgcggtggctcacgcctgtaatcccagcactttgggaggccgaggcgggtggatcatgaggtcaggagatcgagaccatcctggctgacaaggtgaaaccccgtctctactaaaaatacaaaaaattagccgggcgcggtggcgggcgcctgtagtcccagctactcgggaggctgaggcaggagaattgcgtgaacccgggaagcggagcttgcagtgagccgagattgcgccactgcagtccgcagtctggcctgggcgacagagcgagactccgtctcaaaaaaacaaaaaaaacaaaaaaaacaaaaaaaaacaaaaaaaaaaaaacaaaaaaaacaaaaaagctgggtgcaatggctcacacctgtaatcccagcactttgggaggccaaggaggagatcaagatcagcctggccaacatggtaaaaccccatctctactaaaaatacaaaaattagccaggcatgatggcaggcagctgtagtcccagctacccaggagactgagatcatgccactgcactccagcctgggcaacagagcgaggctcagtctcaaaaaaaagaaaaaaaaaatgtaaaatgataaagtaatattataataagtggtataagagaaatcgaaagcattttaagaacttataaaagttaaatgcatgatatataagatatatataaaatcatatatatactataaaatgagatatttcactgcctcttgaaaccagctgcagaatccaactgggatagacccaaactctcaccatactgatctttaacttttaatgtggttcttctgtgtaaaagcctctgaactgccagtcctcttttgccagtcctttcaaatcatctgcctcaggtactgaatatgagaaaagtatccctctagttctatatggtacgtatctttcatgttcgggacttcaacagagatagtggatttcttccagtgcccagctttccatgtgacactgctgaacttactgagacatccgacacctttgggtacctctgactatagatagatcgtatgtgactttagataaattgaagggagagtaaggaaactggacatagcaagaatgaagaggtgtgaagattcagtctgctaagcctaacataaagtgctttagaaaactggctccttggccttgtgaaatatgaataattttttaaaaaacaaaagattttagtgttttaatccctaagaacagttatgtgaagtgggagagaacctcagataaattcttagcctcaacttatgactcaaagtaagaaatttttatattttacttattctagcactaaattagactcacccatattcctattgaattgcttcctgaagcatgttattactacatcagctgtcgttggcagcctatctatcagagggtagaaaggtttctttttgaaattaaaatctcagcaaagccatctctaaaagtttaacaacctacaaattagaaactttctaaattccactgtcccatgcgtcaagttttagaatgatacaaaagaaattacagcttaagaacagtggctagcattcatttagtgtcacctaggagccaagcactgttcttcatttttacagagatcacctcatttcatcctcacaaatatcacaccatttaaaattttcttatttttttaaattgacaaataataattgtacacattcgtggggtatgtggttatgctttgatacatattacgtatagtgatcagatcagggtaattagcatatccatcatctcaaacatttatcatttgtttgtgttgagaacactcaatatcctccttctagctacttaagaccatataaggtattattgttaactatagtcatcctgtagtggtatggaacattagaacgtattcctcttacacttttagctgtaattttgtatcctttgacagtctcttcccattccccccttctccttcccctttccagcccctattagcccctgttctgcttttttacttctgagattaactttttttttttttgagacggagtctcgctctgtcacccaggctggagtgcagtggcgcgatcttggctcactgcaagctctgccttccgggttcacgccattctcctgcctcagcctcccgagtagctgggactacaggcgcctgccaccacgcccgtctaattttttgtatttttagtagagatggggtttcgccgtgttagccaggatggtcttgatctcctgacctcgtcatccacccgcctcggcctcccaaagtgctgggattacaggcgtgagccacctcgcccggccaagatgaacttttttaacagcaagttaagcaccgcatgttctcactcatatgtgaaaactaaaaatcaccctattttatagttgaagaaactgaagttttaaaaggctaagtaatgaccaagatcacacatatacacacagcacacacacatgcctgggagtcaaggattcaaacctaggcagtgtgactcctgaatctgccctctaccctacagcataaaatccaaataaactcatcatcactggggcagctacagttccttgccttcatcaggcaacaggattttggatctgagcacagcatttttcagggcatataattgagcacttttcggtcattctcaagaatacagtgagtgactactgtaagggaggccgtggttcaccctcgagacacacagcagcgaacaagcaggcctctgccatcactgcacgaacactccagaaggggggcagagtaacccagtaaactcataaggcattccagcagcagcaagtgctgtgaaagaaatgaaggtggctgatgggatgcggtgatcaggaagcctgctccaaagagatgacatttggtctccgataggagcctgagaaggagccagtagggaaggctggggaaagagtgctccggaccaagggaacaaatgccctggtgaggacagccagatgtgcctaagttgcaggaagaagtccagggtaactggaacatcaggtggaagagttagctcagaggcttgggccgcagccggggtatgccggacacagggcctatagtcaccgttagtttggctaaataaaattgaaaatcatggagggtttaaactgattcatattttctaactgactctctggttggtagaagcctattgcagcaggacagaggagagatgcgggtgcctcaggaggatatggcggagatgagggagtgagtcagattcgagttgggttcagaggcaggtccaaaaccctgcagtggttccatgtggaggcgaggggaggaaaggaatcagggatgactctgtggattcagctataccgtttgtgaggacaacggtgccaatctctgaaatgaggaagacggaaaaggaataggattggagacagaaggaattaagtgctgtcttttgaacgtgctgtgtgtgtgtgtgtgtgtgtgtgtgtgtctgtgtgtgtatttggagatggagtctcgctctgtcactcaggctggagtgtaatgccgcgatctcggctcactgcaacctccacctcctgggttcaagtgattcttttgcctcagcctcccaaatagctgggactacagtcacgagccaccatgcccggctaatttttgtatttttagtaaagatggggttttgccatggtggccaggctggtctcaaactcctgacctcaagtgatccgcccaccttggcctcccaaagtgctagaattacaggcatgagccactgcgtccagcctgaacatgctgtgtttgaaatctctatttagctagccatgtggatgtgtcaggccggtagttgcaaatataaacatagatgtctagagcacagggtgagaatgctgtatttggggagcatcaggatatagatggtaactaaagctgtgggactggatacacctccagacagatcagctagggaggaagagggaatggggacgaggaagggatctgaatctgagcctgggatactcctgcctgttgaaagaggagttgccagcaaacaagataagaaagaaaagcccccagggtgtgagagaaaccaggcagaatgctgtaagggaaggcaagagaaagagtttccagaagacagggctgcaagatgtgtctgctgctgctgagagctccaatcagatgcgggccaggagaaaaccactggggtcagcaacagtggatgttgtcagcgattttagcaagaggagcttgaggaatctgaacagggttaaagatcaaatggtactggttgagaaaagtttgtgaaatatggaaagagaagcagcaaataacatacttgttggagaagtttggcttaactgccaactaagagataggagctggtatctggaatggagcatggggtcaaaaagatggtttttacaatgtgtgtgttttcaggcaggatttactagaatataggctgaagaagatagtgcaagagagaaaaatagatcatgcaggagggaggagagtaagatggggaaaggaaatggaatctgtactagatggcgagagggtaccctcaagaactagctggcagagagagcttctcaagaatttcctatgtaaataggaaagatccatgtaaacatgtaaaataaatacagacatctcaagttcccaccactgcctccccctgtgattgtaaaatgaattacacagactgtcaaatgaatagctttatgagctccgaagagggcaagatggtggccctgaaatgtgggatgaaggaagctggattaaaccggaccttgtggataaagaggattggggtcaggaggagaggagggcagggcagcgttaaaaaggtagggaagagaaccagcgtgacacagattggcaggtcctgttagacacaggttctcagtgctacgaataatcagataaaatgtgtgcccctttgaagtgacattgtgaagcgtgctgtgatgtgaaatgtggaattgttcctggtaatcacatagggtaaagcccttggtgctgggaccactgccgtgcctctctaggcagagattccattcactgggttttgaaaacttttggagaaaagctaaaccagtttaactttggccattcttcgtgttatctattttaaaataacctttcatggtattttatgatggctctatgctttggtttcttcatctggagaaaatcagattgttgtaagggttgagtgggttaatccactggggtggtgcctagcacacagtgtaggccattattatttttaaataccatatttttatttttaaaaagctaaaatgtacggataaaaagaagatataaaaatcatgtctaggccaggcatggtggctcatgcctataatcccagcactttgggaggctgaggcagaaaaatcacttagtccagaagttcaagaccagctggagcaacatagtgagacccccatctctataaaaaataaaaaaaatagccaggcatggtggtgcacacctgtagtcccagctacttggaaggctgaggtgggagggtcacttgagcccagcaggtcaaggcagaagtagctgggatggcaccaccgcactccagcttgggtgacagagtgagaccctgtctcaaaaaataaaaataaaaaagcatgtctaatcctagtgccttatgacagtcactcttaatatttttatctttccaattttttcctacatgtgagtacttaaattttgctgtatctactcttttgaacttttttttttaatttaacctattctgtcacagacatctacccatgtcattaaacgttctttaaaaccattctaattcctttgtagttgttcaacatttataaagttatgtgtcactgacattgcttcggttactctgatctgtaaatgattcttgctgtattggtaattatagcaactgatttaaaagagaggaaaagaagtaaataatagaaatgagagaaaggatgtatttattcctcaaatcttgaaaggcaaaatatgtataaaaggataaactccatgactcagttcagtaaagtcagttagagatttaaaacatatctatataatatatattatgtttattttatttttatatgtttatatattttacttatatgtattaattatatatatttaaaaaaaaattttttttttgaaaagtctcgctctgtcgctctgttgcccaggatggagtgtggtggcgtgatctcggctcactgcaagctccacctcctgggttcacaccattctcctgcctcagcctcccaagtagctgggactaccatgcccatctaatttttttttttttgtagttttagtagagatggggtttcaccgtgttagccaggatggtctcgatctcctgaccttgtgatccgcccacctcggcctcccaaagtgctgggattacaggtgtgagccaccgcgcccagccagtaggtttttaaaatgaaaagggagcaccttttaaagtcaaggcaggagactcatttttgtgacatttccactggccaaagcctggagcaggatcgtcggcgtgtgattccttcactctgcgtgggaggcagaataggaaaagttaaggtttaggcaggtaactgttaggtgaacagatgatagtaactacaagggctagaacatgtaactctttcagactggagcctacatccaaaactgaaagtgacggttaataaatatggagaaagacgttaacctgagactccgtagtgttgtttttttttttttctcctgaccagcaggtgcaaagcagatgactgaagtgggaacagagtgggagagggcgggagaatcgccctgaggggaaggcagggaactggctggcacagagagggagatttgatctgcccccgtctccaagagctgctctgacacctgagatgtaaggtgactttcagatttcacaagggttggacaggtgtgcaaaagctagcaaatgtgtgtttattcagggggccccagcctttttggcccctttttcctttgaaaatcagctggaaaaaagtagcaagaatggctttctaaagagaggtcatcagaaggaattttttgttttttaatgattgaaacattttgaatcaggtgaaaagtaactgttttctctccccaatttttcgctaccttgagagtgtgtgtgataacttccatatggtttttgccacccctccccttctcctaaatgcttttatgattccagtaaaatggtctcccgggtcacccccgaccttctgatcgccttcactggcttttcctcagggtttctcagctccctgcatctcctcatcacagagaaaacttctcctggcccataacttgtttttgatggtttgttgtttgccccgtttgtgtccctactccgccagttaatcctgcacactgacttttccagcccccactctcggtgcctacacgaccaggttcaaacaagtcagccccagcgtcccagtcctgcctgtgtttcgagatttgcctcccgttactgcccccagcctgctgctcctctctccttgcacgatctgcgcctcgtccccagacaagctttaccacttcccagttctctttcttcattccagcagaagcctggaaggtgtgtatgaggaaggcatgaagctaggccctctgaggaactcacacgcgcgcacctcatgaaggccacctggaggtcacgtggtgtgggggcaaggtcacagaccacgaggctcaacaacaacagtgctttgcctgtcaccactgctttctagttatgtgaccttcaattacttcacctcttggttccttggtgtccttgtctataaattggacataattcacttcttagtgaggttcattatgatgatgattaaatgaggtaaagtgcccagcagacgccgggcacataggacatatgcaaaaattggtagttccctttctaacccagcgtccatcctcagggaactcatcattttctagcaggcatgatattctaggtgacgtgagtgctgtaaacaagaacgctgggagttcagagaaagagcacagaatagtgcctgggctgaccgtggaagatagcgtatcaagaaaagatggataggagtttcctaaggagtgaaaactatgactaaggtacaggcatggaaaacaagcagggagagagagtccccactttctctgtgtcctaggggaggcttccttgccaccatccttaaaattgcagccccccgggaagtcccatcacagcccgtgcccctcccctgcttgatgactttcctgcttcactcaccaccgtatcatgtacttatttctcttctgtgtcctcacaagatcagaggggtatgtgtgtgtgtgtgtgtggtgtacgtagtggatgtgggtatggtgtgtgggggggtatggtgtgcgtgtgtggtgtgtgtggtgtgtcgtgtgggtgtggcgtgtgtgtggtggtgtggtgaggtgtgtatgtgtggtgtgtgtatgtgcagtgggtgtggcagggtgtgtgtggtgtgtgtgtgggtgtgatgtgtgtggtgtgggtacggtgtgtgcgtggtgtgggtatgtgtagcatgggtatagtgtgtggtgtgtgtgtgtggtgtgggtgtgtgtaggtgcgtgtgtggtggggtgagtatggatgtgtttggggtgtttatggtgggtgtgtgtgtgtgtgtggtggggtgagtatggatgtggtgtgtggggggtgtgtgtgcatggtgtgtggtggggtgtgtgtgtggtggggtgagtatggatgtgtgtggggtgtgtgtgtgtggtgtgtgtggggtgtgtgtgtggtgtgtggtggggtgtgtgtggtggggtgagtatggatgtgtgtggggggtgtgtgtgtggtgtgcggtggggggtatatgtgtgtggtgggtgtgtggtggggtgagtatggatgtgtgtgggtgtgtgtgtgtgtgtggtgtgctgtggggtgtgtgcgtgtggtagggtatggatgtgtggggtgtgtgtgtggtggggtgagtatggacgtgtgtgggggggtgtggtgtgtggtggggtgtgtgtgtttgtgtgtggtggggtatgtatggatatggtgtgtggggagtgtgtggtggggtgtgtgtgtgtgtcctcttcactgcgtatcccccttacttatggagtgcacaccattagatgtgcaggtgaactcagctctctgacttaaggttacatgacttggaagtccaagaagttctggcagatagaggtagaaaatgaagttggaaatcatgagggccattaaatgacaaatttggggttttttattttactgagtagagattctaatcatctcatttttaacagggaaagtgtgctctaggaaaatctagccgacacagggagggcaacgatgaatttgagaaggaggagatgggaagacaagaatggattgtggtagtccaggccccaggcaaagaaagcctacactggatggtagacacagaaataaataggaagggacagcaaacattccagcagagttacctaaacatgactgttttcaatgtcaataaaagactggaaaacatatcacagtagagtcactggaaggaataccaggcagctatccaagagaatgcagtgaacgtatgtattctaaatctactgataggcaaaagtagccaaatgccaagtgaacatgccatgtgaatccatttgtataaatatgtacataaatgtaaatatgttgatatgctgtattaaacttatccaggccatgtgcggtggctcacgcctgtaatcccagcactttgggaggccgaggtgggcagatcacttgaggtcaggagttcgagaccagcctggccaacatggtgaaaccccatctctgctaaaaaaaaaaaaaaatacaaaaattagcagggcgaggtggcacatgcctgtaatcccagccactcagaaggcaggagaatcacttgaacccaggaggcagaggttgcagtgagccaagattgcgccactgcactccagcctgggtgacagagcaagattccgtctcaaaaaaaaaaaaaaaaaaaaaaaaaaaaacacttatctggaacaatacacatcagacttaatgtggtatttgggaatggcatttaggaaggtacccactgatctttactattaggctgcacaattctgtgctatatggttattttcctataagcatgtattattatataaaagaatataagtgacccaagttaaatgtatcttggaaacattaagaatatactttgaaccattgcaattttttaagtctgtcacctaaaatctcttgacatgaaatatgtaaacatcaaaatctgactgcagtttaccttttgactaaaaatctggtaagttgaccctttatttaagaacagtaataatgcaagtgaatttgggaaggcatgatccaaaatcaaaggccctcttattcaagaacagaaccactgtcatactcagttttacccaggagccagaaagcatcagtccttaccctgcaatctctggagaaggttacagtttaaaagcgtgggtattcttcacacaaacacacacacatctttatttcatagtttatagccatttaaaagtacggttgtgatgaccacagtgataaaaatgaaattaataataaatctgtcattaaaagtatattgctttgaagaaagctatttatagtagtactttttaaaaatgagtttctgaagaaacagtacaaataaaaaattgtctgagcctgaatcactctattttattgtgtgtttcggtcaaaaagactttgtatgttattttatttaagggaaatataattctttgcaattattatagataacactgatatcttaactttaccattatctttaatactttcccaggtgccagttcaacagattctgacagtgaaagtttagctttcaaatcaagagctggagctatgccacagtaagtgcctacaattccatcgattatgtggaaacaaagaatggcaacagaatggttggggtatgaaaccatgtttgctgtgctttgaagaaaaaagtcaactgatgttaatcagagatcaaatactgaggttggaacacaatttttttttttttttttttttttgagacagggtctcactctgtcacccaggttgaagtacggtggtgcgacatggctcactgaagccttgacctcccaggctcaagtggtcctcctactttagcctcccaagtagctgggattataggcatacaccaccacacctggctaatctttttttattttttggtagagatggggtctcactgtgttgtccaggctcatctggaactcttggactcaagcgatcctcctgcctcagcttcccaaattgttgggagggattataggcatgagccaacatgtccagcccgaacacaatttttaacttgtaaatttgaactttgaagtctgcatttcatcattgatatgccagaattttaccatatgcaatgttagtttcaaagacagccatctaatttattataaatgtatggaaagagaagtcacattaagagaaaatcaattaaatcattactaaaatgtgaggaccaatttatttatgcaagttggaaaatatctaattaggccagaagtaggttctcctttggatacgatctatatttatttagatcttgtacccgaaattcacaaaacttagttattcctacaaagacataccaattattaaaatgttaatatcttaattatttggcaaaaataaaatctaccagaaattcctattatggaaaagtccataaatattgagtctgttctaataaatttcttttatctgctagtatgtacataaaaattatatccattcagcatcaaataatcagtgatgcttaaaggatcttctaaggttattttaccacccctggtttttataaggagctcaagtttagtgaagttacatggcttgcttcagatttcacagccagctacttgacaaagctgggcctagaaatcaactcttcttaatcttctctaaatatctcactaacttatatgcactaagaaaacacaaaaattccaagataccgacaacaaaattagaaaccagaaaaaagaacagctgttagacttaaaatagacaaccaaaactttgagttaaatataggaccctaaccctaaacatttcaaatctctgcttatcaataaagattggattttttccaaatattttctcttaggattttcaagtttaatacgttagcatcttcaacagcgtctcagttacatctagctacttttcttttactcatgttttgattttgcttaatgtctataaggtacattctataaggtacatgtatatactgaccacagctattctagctgtaggttatgcattcccattgtggaagcaattacagttgaagcggattgcgtatacaaaaagaaacccagcttttctgttgaaacgtttcaaggaattatttctgctaaaaaaaaaaaacaaaaaaacgaaaacaaaaaatattctgactaaacactcaccttcctattttccagagctcaaaagaaaacaacttctgtttccttgacaataggatcatcatctccaaagacaggggtgaccacagctgtgattcaaccactgtctgtccctgtgcaacaggtaagtatgctttgagccagagcccataaggggtcgaactcatcagcaaacttgtggattttaagaatatgactttgattctaactagtatactcccttgaaatattttctaagtggacacaaaattcagagcaaagaaaattgtaggtaatgtttctcctttcagttcactaaaaacaacctttaaccaaaaccacactgccaattagtcaacatttgcatttccattgggaacttctttctctaacagctaataatctgataaactggtgtctgttttagctgtaactatttgattattccctcacatgtgtatgctctttcatatagccaaatttattagctcattacaaattaaaagacaagtctgcataccaacaaaaagctttcccactcctaaaagctaaacaaataagaaaaaacaactcaaattccttgacttcaccatgctttttgatcttgcttttattttattgtaagactgctatagccatgaaagaacaataatataaactactggaaagtagttgtaatgaatttactttgcaaacacaaacaatatgaacttcttttaaaaaaaaaagtagaaaaccattacatctggatgtctctaaatcatggtttaatgaatatgttcaaagacaacactcacagaaaggttttcccccacagtctggaaatgtaaactcattcctaagtaatgagtatgtcttataagtatcaccatgtcctccctcagcctttattacctattgaatgctcaggggtgtttcagccactatagaggccaataggtgctatcgatatgtggaaaatacaaacagtagagagaagacatttgggtccataaacttgaatcaacaagtatcagttactcagagatggcatatatagtacatatttcctttaaaccccttaatcagagtggaatttatagaaatatttgattaaatcagtgggcattttttggtatttgatgtttaaatattgataaatatttattgagtgcttagtacggtgctaggcatttcatgacaggaaaaaatgtcacccaccccattcccaaatggggtgaatgtgacagaatgtatttagatgtaagacagaagcctaggaaatagagagatacacacacatctagatatgtaaataccataataatgtaaagagtgaatttttaaatggattaaattctacaaagacatggaatggaaggtaatttaccccatgtttatagttgggagaatgaagcacccagagaaactccatcgctttattattgcaggcaatgtgacatcaagtaatgctctggaaccagactccctgggtttgaatcccagttctatcacttcctaacggagggaccttaagcaaataaaatgtaacccttcaagccgagtttcttcatctgtaaaatgaagatgataacactatgtatctcataagtttgtcctgaagatccagtgagttaatcttcatatgacacttggaacagtccctggcatagagtaaatattaatactataagagtgttcacatattcttgggacataaaaagacagtgaaaagtgaaacccagacctcttgaatcacaggccagtaaagtcttccagggttaatgaataaactccattagcatcctagcatctctaccgctctgccacaattcttcatgatgtcctgtggcatatttagacacacgataccagatcaccatcatcttgggttaagaagctaacaaccacttacataagtgaataaatccagatcatttaaaaataagtgatagtacacaaagaaatattttccattcactactctgaaatccttatatttctccagagatgaatgtcattgaataggtattttagcacgtttcttttttgcacgtcaataaaaaaaaattcttttctctcctttcccataatccctatatcaaaaaagagtacaagttaaataagataggtagatgtttgataatttaccctccagtgccaatagccaatggcttttatgcattgaatccaaactgtatttaaaaataaaatacattgtctacgagaactttaaaaaagacgcatgtggaagtcccacacacagaaatccatttggtaatagcatttaaaagctcgtggatccccaaggacccagggaacttttaccttgaatatccttttgaacagagaagagtaacagatgtgaaatgaggaagtggaacaatgtctgtactgtaagagcagacgagcaaaatgatgtatggtggtactttcattcactcatttccttcaagtgggtgatccccataatgaaaggtttcttcagcccatcttttaggcaatttatatatttagaatttgatccatatgtctctgcttttgcaggttcacagtccaacttcatatctctgccgacctgatggaaccactactgcctactttcctcctgtttttacaaaggtctgacatctggaagtctcattctctgtgtttgctttggtccttaaatttcatttacatgtggcttcgtgtagcaatctttaaaaattaaaaggaacagattagtaggctgattaccatggttacctttgggactaaatagatatttgttgaacgactgccgtgtgactgtaatcttgtgatgggttctgagagatgtgagcaggaacttgatagagcctaaaatctagtgggaaagccaagacagatagaaaaaaaaaaaaaaaaaaaaaaaaacctgctgtgtaggaaattgcttaggagatctagcaagttttatagaaattcagaaaaactgactaattttccatttgtcctgagtccggaatttgcattgccaggctgaatgacatccatttcattggtcagcctctcaagtcagaaatgcttccatatagcatttcttctctttctttttcctttttccttccttttttttagagaaaattataaaactttattaaaagacattttaaaaggcccaaataaatggagacatatgacatgcttgcagactaatagaccgtataaagccatgactccctgattaatctgtatttaatgtaatctggctaaaattctagcagcttcctgggtttttttgttttggtttggtttgttttttttactttaaattctgggatacacgtgcagaatgtgctggtttgttatgtaggtatacacgtgccatggtggtttgctgcacctatcaacccgtcatctaggttttaagccctgcatgcattaggtatttgtcctaatgctatccctccccttgtcccccacctcccgacaggccccaggtgtgtgatgttcccctcccggtgtccatgtgttctcattgttcaactcccacttataagtaagaacattcagtgtttggttttctgttcctgtgttagtttgctgagaatgatggtttccagcttcatccatgtccctgcaaaggacatgaattcattcttttttatgcctgcatagtattccatagtgtatatgagccacatttaaaaatatggaacgcttcacgaatttgcatgtcatccttgtgcagaggtcatgctaatcttctctgtatcatctcgatcttagtatatatgagctgccaaagcaagcacaggttcctggtttttaattgtttgtttgatatggaatttagcaacctgattcaaaaagttgtgtggaggaaaaaagtggctaagaatagccaggatacacctgaggaaggaaaataaggtagtgttaggaaggagtgggatttgtcctataagatagcaagacgttttaaaggtatagtaattaggacagtatggtactggtacaaggctagagaaattgatgtgtaatcggagtagagcccacaaagtttctgaatacctacagaaacttgcaaattgctggagaaagaatgaattcttcagcagaggtgaaaaagtatccagttggactcctacctcatacttttcacgacaaacaattcctagtaaactaaagacaaatgtgaaagcaaatctataaaacttttgtgaggcagtaaagaaaagcatttttgtaatctccatagaaggagtgattttttttcccttcagctggttgaatccaagctttataaaatatcttttcataagcagttatagtatttccagttgggcacaggcaacaaatgataacaggtggtaacaacttggaaactaccctcctagctagactactaaaaaagaagttatgtaaaaccctgcctaaaaccatgtcaatctgataaccaatgaagtcttcctttgatgtttagaacagaaaatgtttacagaggggtggacactccacatttaggatgtagtttaagagttttgcacaagcagcttcccaaggtcatcaccagaaagggtgtgttgtccaatgtattggtatccaagacacagttgatttgggggtgccagggcccaacacgcctcttggtttaaacaaataaagtccatgctggtggcacaagggaaggaaaagaggaagcaaagatttgctttctttcactaccgggctttcctgcatgggtctggcatgtgtagatattatggaattcctcctgggcaccaagaggaactctcaaatactaagtacaaaatcctgtttcctcccttgcaatccagctcccgcaacatagactttctattagtggtctttcccccttccccaaaagataaccatgaagcattctttgtgctaacagcacagctttaaagagaagtaaaccaaaactctgttctttatataggttgatttttaagaactctcaaactgtcaattcactggaagctcagagccactgaaagctcagagccactagaagctcagagccactggaagctcagagccacttctccagccttccactttctgtgtctggaccatggaacatctctcttctgcagggctgttcccttccttgatgcatctgcttttccctttctcactttaggcagcttctgtctctgatttgcagggtccttcttaggcctggtctctggttttggaggggtaggtttagaaaataatcctgctgatctcctctgtaactcaaactagcctttactttgtcactcatagcaccttcactgggctttctcttaggcatgatgatgacagtgaatggcaggtgggctggctttcatagtccaagggttacctccatctgttttctcatgctactctggaagagattcctaggtctcacagctggtcagaggcagagccagtgctcctgcctgcaggccacctggcagactggtggaccacaggactgtgggtagcatggacgtacatgtgacatttcttcccaaatagacccctccaaagaatcacaatgtcaggtggacttgatggtatggccagaggggtccttgtaaggatcctgaaacccccagggcccccagatcctacacaaagtagatgatccaggttgccaggtgcatcctgtaaaggttgactttcagtctcctttggggctccttgttatgttcccgaaggttctcctaatggcttactatgtttagccatggcttttgccaagataaaaatgttagctccaggaggatccaaatggcaatcctggaataactgtggagctttgactgattaagttacttggcatctacccatttcctacatctttgactttccgacactgaaaaaaaaaaatgcataatcttaggaataaatcaaagtctcttttggtgcctcaaagctgaagcatgaaaaatattttggtgccatttgtagtctatcctgaacagcttcctggacaagcctagagacatttaataggttaatccgtagaagctggaccccataagtgacacttaccctgttttgatctaataaattagctattctatggacccagtcacaaaggaagaaaaatatgatttaaaaccagagattttctccatttaaaaatacggaagaagaaagaacgcaatcagaaatagttgatcatctaaaccttgtcacttaaagacattctagttaactaccaaaatgtctatcaaatgtcttctcagacttcacattagacttttatagttcttctgccaatgtcataggttttagaattccctcagggttttagcacacttactgcaggacattggttacagaattggttttttccaggacatcatttattgtcccatcagataatttaaacacacatgcatacaaacaaacaaaacaattcacacttcctaatgaatgtgaatttgtttgcttttggtgtatatatggataaattatgtttgagttattttgagagtcctacaccttacattcgatccaatattctttttttttttttttttttttttttttttttttgagatggagtcttgctctgtcacccaggctgaagtgcaatggtgtgatcttggctcactgcaacctctgcctcctgagttcaagtgattttcctgttccagcctcctcggtagctgggattacaggtgtctgccaccacgaccggctaatttttgtatttttagtagagacaggatttcgccatgttggtcaggctggtctcgaactgctgaccctaggcgacccacccaccttggcctcccaaagagctggaattacagatgtgagccaccacacctggcctagatccaatattctatagtcagaagtttaaatagtaagaaagtttaaaaggccctattgctagttaattctggagaaggagggtagagagaagatatatgtgagggaaatattaatgtcctgatatttaagaacaagtataaaagctttacttctttgtatctataaaaccaaattaatttctgatctgttggattgtaaagatttattggtctggagttggagtgcggtgagggacaacaaaggcaggagcaaagaaggaggaaatgaaggtcaataaggaagaagtacagcatgtttcattactttactcagaatctcaaaatgagaaaatgtagaaaccccttagcttaataaacttgacataggaaactagtcaggcagaggtggtacatgaaaaggctgaggcatgtgaaaacaaatgcatgtcttttttctcttcttgtctggttttcataagaatctacttttatttagagtgtggtcgtttcaagaaattcacattccacctgcttccttttaaatgtagataaagaaagttaacattggttaccatcaaattccataaatgcagagcagtcagtgcaaatttgcagacaggccagaaagctctacaggacttatggtacactttactcattttatgacttggagagggtgaaaagctgataatcggtgggtccaaaggtgtttatccttacctgagtcagtgctaattatttgatgatgcaagttttgcattttgtgtttgtatctgttttgtctgaggtttggaatttttattctgtgttgtgaaattgcttaaaaatgcaccaaagtctgatggggttttccttgaatttccttgaatttcaggaactgcaaaacacagccgtggcggaaggccaggtggtggttctggagtgccgggtccgtggggcaccccctctgcaggtccagtggtttcggcaagggagtgaaatccaagactctccagatttccgaattctacagaaaagtaaggagaagtgcccatgtccccaaatctgaccattttattctctccagcttcaagaaaaccaagaagggctaagtcattaagatgaattgatctctatgttcaaagagtggcaggatcagataatctacagtgtgttgaaatccagtaaatggaaactatgacccccttgacactctaatgaaagtcatatattctttcgtcttaaaaaatgcatatatacatttgtactcaaatttgcatgaataattttaggaggtttaccaggctcctagagcccatctatgaactgcagttggaaaaatttcttagtgtaagttgatacaggaatttgagtttttatatttatagaaatataaaccgatctatcactttatatcttttgtatgatggagtttgactgtaacatttcttcagacatgtcctagacaaggtaatggaaaggaacaagtaggttttttttaattaaatggaaccccattctaatactttgttctaatttatttttttcatgtggcaaacagaacctagatctacagctgaacctggtaagaatatttttagggtttttttttttggtggtgggggagcagataatgtatcttttgggtctcaatagttctttctttctaccttaaagccgtaagcagaacaatgtttttgtggctccctggaaatgtgaaacccccttaaaaacaatatcttctttatcatggagtctgtacactgcattttacatcaacgtctttattagcaaaacattaagttccattcagacaagaaggtcaagctcagtgacttcatgctttttaaaatacagtcttttaggctcagaaagcaaactaagctgatgatgaaaaaacatcctcctaaaattccagtagagaaggacaatctactgcctatttgtactgatcagaacccactaacaaccccagcttagaaatgtgtctcaaatgagagcagctcaaagaggtaagcaaaatggacccccaggtgtttctcatttgtgtgccctgagccataaacttttactattctgcaagcatgaagaaagtcatcttgcccccagatcactcttaattatcaggtcgtttgaccagatcacagtgctatgtgatccaggagcctcgggcctagctgttccctgcctcagacatattgcgtatttatggttcctcgtggagtgaaatagtgtttgtaaaggaaacaaatttttgtctaggtacttcatcgtatgtcctcctcaagactattttcttttgtatttttcccatcagcagggtcacaatttcacttatttctgaacaaagggtagaaaaacaagtcattttcctgtttctcctgtttgttcctctgcttcagtgtcaagcagatcttgccacatgtgtcttaggagccatgaccttgctctgactcttcttgggggaactggaaagtcctctgtgggccactgcaggtcagattactgcagtcagtccctgaacttctcacatctgtgtactggatctttaaaagcagagtttgaccctattaggatccaacgtttaagggaggctgagtagcatccttagggaacaactggaattgatctgctgccctcctgtcatgaattataagcagagcaagtccccccacttaatgtgtcagtcatcacatcaaatactgtagtcactttccagactgtggaaatatacaactgcatattttgtctgtgaaatgtcattgaataaaattgcataatgctacttttctaatacatggattttctgagattaaatctgctgcatgagctaatatgggaatcctgtagggagttagggcacatcttgtgcatttgctattttaaacaactttagataggtagatataaaagtaggaaccaaatatcttttatctacaagaaatagctttttatgtgaaacaaacctataaagcaatttatgtcttttaatgctttgtgtataaataaggctaaaattttgagccaaaaattgtaaaaatgttactgctagcatgaaataaggcagcttttgacattgcgttttggattcggagtgaactcctgcaactctcttttcatcgtgttgttatacgttgtcatcatgcacataggtgatgatgatttatcaaatgtaggttggaaaatcacaaacagtcatctgcaaagtcaaaacattagttagaaactgcacagcttagttttcagtatgtgtatatttgaaaagggaaaacactcagaatatgctagctaaggaagaataaatttggatgaggagggaggaaggaaacatctcccccgcaccctgcgtcttcatcacttatcctacatacgctccttctgtttcagatctcccccgcgccctgcatcttcatcacttaccctacatacactccttctgtttcacatctaccctgcgccctgcgtcttcatcacttatcctacatacactccttctgtttcagatctcccctgcgccctgcatcttcatcacttaccctacatacactccttctgtttcacatctaccctgcgccctgtgtccttatcacttaccctatatacactccttctgtttcagttagtttgttgctttgcttctaaactatagttttgattgtgaattatttaataaaattagtcctaaacagcttcatggaatcacctgacctctagaacgtacttaaatgccatttgctttaatgtagcaaaatcatgcagaaaagagcaagatatggaaggccttccttttaaatcccttgtcctagcaatgcagaaaaatgtttcctctttgtgttcactgaattttcttatttacatagttagatctgaaagcgtttaagaaaacagattccttcattccaactacaataatagcattttctgaaaaatttctcctggcagagaaatatttctagcaaatctgtcaatacaccaaaaaatattatatagtcaggagctattaaaaactaacacaatgagttttcctgacctacgatgatttctccacaattgtttttaccatgacacgacgagactttcttctttcccttttacagcgttaaaatgctgtgcttcaggaaatcagccgttggcatgcagcattaaataaaatccatgatcatgttttttaaacaaaaaaaacccttaaacacatgaatgaccacgcaagtgactaattatatgagttgttgtgagtaagaacttcagaacaagcaaatgttacagtgtatttgtgcttaaacaatgttttgtcatgcctgtcaaaactaggtatgattcttttactagttgccaagtgttttccttacattgaccttgaagttgctatgtcagaggaaaaaacaaaaaataaatatgactgtttaccttctttaaatgacctgattgactgttatatctaatggacctctgagctattaaactatatagaagtatgtaggaaccggcttccctaaaaactgttttcttagccattgttaagtggaaggaagaaaaacagacgtgactacaatacatctgaggcaagagataaattttataggactaggtcagtgatattttccaaatgctaaaacataaatagcctttgaaattcaggaaaacatttaagcattctgtttttattactgtctcttcctaccctcttcctttcctctgagagagtcactcttgctcgctctctccccctcctctctgtctctttctctcccctcacctccttcattccctgcctctcttcctctttctccatctcactccctcattctttttatttattttttctttactcttctctttactctcttctctttactctcttccttattcatgggcaagatgttttaaagctccagaaataaagttgaaattccctagtacctagatatagccccattaggaattagatatttagataaagaaggaaatagcaggttgtctccaaatggatctgtgcaactgaaacaggtttttcttgtcactgctgcgtcgtatctgtctgatgtgttttacactcccctctctgtctagacagaagtcagcttgcatcacaaatcttttcagactgttttgtgaattaatagctagtcagcttacttaagaccaacatccgtttgtcatagtaccttctctggccttctttgaaattctgactttgtactgatagactccttcaaagactagtctgggggtgggggacacagaagactcatttgacagctgttaatactcagtctcttactcactcagctgtctggaaacagccacaaactgtgttgagttacttctatagcactgtctaatagcgtgcaaaattaaaaacacaaaaacgcgtcttactggttgtggaattatacatataaaagtatattgcctcctgctttcaattttaatttctgctcaccagtgtgacccatgctagatcttgtacggtagagtctaggctttgattctctgattcaaaatataaagtaagttacacttagttaaatgtactaaggtgctgttgtaggagggcaatgatagggatgtttcttgagatcccagtagattgtatgcagtaaaaacttaatgcatgttctaggttaggacggtgggttgaacaaaagtaggccatatgaaacttatagttcaccaagagtgtgacaggatgccctggggtgccacaccacgctgacagggatgctgtaatatatttgaaatttttttatgcaaacacattcaaacttgacatttgacagatatgacacaatgactggcttgaactagttcagaatttcaacattagatcaccctccattcttttctatgacataatctctttgtgaaactgagtttttgatgagtgtgtgataaaaagtaagtacctcatgaaaatccatgtaaaacatgaaatgaggctggctcatccaatctgattccaagagaggtggtacagtgcccagcagatgcacacagccattagtaagaaatagtggttatttaagaataaaataatagtatttttctttcaatttatatgtatttttaaacactaaattgtttaggcataaacacttattaagttctttggaaataactacataacaaacataactattagttatgtcttttggcttaggagcaccatttaaaaagtattgagaaacttagagtcccatgaaccaagaaagtttgttttactctctagaggaggagtgtccaatcttttgaattccctgggccacactggaagaagaattacctggggtcacatataaaatacactaacactaatcatagcttttgagcttaaaaaaaaaatctcataatgttttaggaaagtttatgaatttatgttgggccacattcaaagctgtcctgggccacatgtggctcagaggccacgggttggacaagcttgctctagagggagagggggaagactcaagacacatttgagtacacagcaaaaagaaaattgagtgggttttgaaattcttaatgccaaatgtgcctatttccagtcctcttccaggactcacattccagcctgctggcctatgaactttacctctctcagcagagactgaaggactcttctctgggcaatttaaacatcccgagagaaaaaataaatccaaagataatgatttgggagtttctcttataaagatgccacttagattgtgctatagggaaggccaaagtggataagttcctctcttatactcagagcttaataaactcccatccctgtcagacaagcagagagaaaaggcatctggagaaaacctctagcatgaatgatatagaaaaaaacaagtgaccttcctaaaagggaactttgagaaaatgggtttgcaaagagaggaaaatgtaaaacaaaaacaaacaaacaaaatctctcttaaaggatccaaggaaatcattccacccaagaaataaaaatgaaaagctagaaaaaaaaaagagaggggaggacacttgtaaaacagagttcttgaaatgaaaagttcatagcagaaataaaacgagcagatgtcccacaaagtacagcaaaatgacgaagaagggatgtaagagagaaaaggcaacaaagttagagatgcatagctgaataactgggattccagaaggagagaagaaagaagcggcgagagacaggattatcaatgaaataatttttttaaagttccccaaactgaaagttatcaattgccagatggaaaaatccactgattgcacaacatatggaataaacccagacccaggcacgtcatcatgaaattcagaatttccaggacaaggagatcatgttataagtgtcctgggagaaaacatcaggttatatatacaaactagcaagatgcaaatagcttaggccttctcagcagtcacactagacacaacgagacaatgaagcaagaacttcaaaattgtgaaaaaagttacctacaacttggaattctgcccctaggcaaaacttcacatggaaatctagcaaagatattttcagacttgtaagatcccccaaattttcctctggaacccgacagtgtgctccaccacagcaagagaattaatccagaaaggacaagatgtagaggtggggtacaggaagcaggagatcacatagaagcaagaggcaaagggcatccccaggagggtgacagctgtgcatcaggaatgaagggcaagttcagattgaagcctcgtgtctcgagggacaaatgcaatgaggctttcatcattaggaggttcattgcctctggtccagcccgtcttttatttggatgacagaatggcagggcggtaagcctgacccagaaatctcatgtctacttgggctgtcctgctctcccctccatggactgtcacctggatcagctgggaacactcatcttacccccacagaagcgttctgctttggtcagtcctgacatctagaagtcggccatgttgagtttaattaacccatctatgcctgaggttgcaattttttgaatttttgcaatcagaccttgacgatgaccttgagcagtaggatataagtaactcccaaatgcttagcattccaataatggaacactaggcataaatgggtaaaaagcagaaaataccagcaatctcattgctggatatatacccaaaagaaaggaagtcagtatatcaaatagatatctgcactcccatgtttgttgcagcactattcacaatagttaagatttggaagcaacctaagtatccatcaacagatgcatggctaaaggaaatgtggtacatatactcgatggagtactattcagccataagaaggaatgagatcctatcatttgcaacaacatggatggaactggagctcattatgttaagtgaaataaggcagacacagaaagacaaacatcacatgttcttacttatttgtgtgatctaaaaatcgaaacagtagaaggatggctaccagaggctgggaggggtattgagaggctgtggggggagatgcagatggttaattggtacaaaaatatagttagaaagaaagaataagacctagtatttgatagcacaacagggtgactgtagtcaataagaaattaattgtacattttaaaataactataagagtgtaattggattgtttaattggagtataattggattgaataactaaaagaataaatattataggggacagataccctgttctccatgatgtgattatttcacactgcatgcccttatcaaaacatgtcatgtacccagtaaatatatatacttcctatgtaaccacaattttttttaatttaaagaaacaaaatatggagataccatctccagcaacaactatattcctgctggatgcccacatgaggccccaccagactgctccaccgagtgagccttatatttcccagattcactcaagaccttacccactgagtgccccgtggggcttttggaaactttcaaggacgttgaatctagttgatggcccaagatggttcttgggatctttttcctaacagtgacaaggttactttttctttagtcagccaagatttgtgctcactacttaatttttttaaactaaagaatgcattttttaaggatacatacatatatggtaaacacataaagaaaatcgaaggaattattatctcaaaggagaaggaaaattaaattggggagagcctatgaggtatttctaaagcactgggaatgttttatttcatagacttgaggatagatacacaggggttcatttcactgttattcgttaaatggtacattttaaatatccttctttatatatgatattaaatacaattgacaatttaaaaaaatcctttgcaatttttttcttttctgagacagagtcttgatctgttgcccaggctgcagtgcagtggcatgatcttggttcactgcaacctctgccttccaggttcaagtgattctcctgccttagcctcccaagtagctggaattacaggcatccaccaccacgcccagctaatctttgtatttttagtagagatgggattttgccatgttggccaggctggtctcgagctgctgacctcaggtgatccaccagcctcagcctcccaaagtgctaggattacaggcgtgagttactgcacccagcctcctgtgcaaatattgatacaagcattacatttacccacactggatttcatcttgttgattttagctcagagttcttttttaccaactgtgttagccaaaccatgtggtgtgaaaggtaaaagctggatttcttttttagggacttgggacaaaaaaaaaaaaaacagttgcaaaggaagccatttatgaaaatgtccccttattacccagggaacccagtaatcttatccttgctgcctcatcattttatgagtttccacaaacaaaatggtttttatttgtatttaaccaagtgttaagtaggtccaggaacttgaatgcaattcaaggttgccttctgggagatattgctgtgattttgtaatttttaggtaactataaagaacagaatttatcaccagtaaaaacagtttctgatttagtaatttattaaatgccctcaaatcaaaaccttaggaaatccaaacatgggaaaattagattaaaatgcatcataattaaggttattaataactttaaatttttccatttatactggagacagtttctttagtacagataagtaagtctctaaatccctttatgtgacataagcagtcattttctgatttccattccttaccaaaatttattttacagatgtcttatacgtctttgttcgagtgagatgccaccagatgaaaattcagtattacaacctggctcatctcatttcctcatggctttcttcatttttataatgtcagaaccatacaagctatgatgcttctttctctcaacaaaatgtgagcctcttgtcactgttggatgaacttttctttgagaagaaaagctgaggaacctgtgggacattgtattcaaattttatctagttaaaaaaaaattatctagcaaaaattgctgtgacatttcaatgcatgaggatcactaaaagaacatcctagtgtttattttttatttttctatttttgttctttaattctgtaatttttctaaatgttccacgtgaactatatacaggcatataccttatttatgcatggaagtattcctataaaatcatacacaatgaattctgctcaatcaactttgaaacacacaaaggaagcttgtaggaaaattggtcttactgagaattcctttagaaaatagtctttttacaaagcaagtgtttttttccttcatctaaatttcatgcatgcatttatttaaacataattatagggagcctaccatgtgtgagatgctaagaatatggccatgaacaaaaattgtttctgcactcagaggttatatttcagcgaaccagaaactaacaaactaattacacaataaattatttagcagggtgaggtggcacatagtcccagctacccaggaggctgaggcaggaggattgcttgagcccaggagttcaaggctgcagtgagctatgatcatgccacttcactccagcctgggcaacagtgaaacccctgtttctaaaaaaaagattttaaaaataaaataaaacaaaattgcaccagctttatttgattttgtgattgtcttctactgtctgttaaaatctcccactagaggcctgggcaacagagcaagaccctacctttatgagtcaatagatagatagatattatttaattacagttgtgatgatattatttgtgatagatattatttcattacagttgtgatgtctccaaaaaagtttaccatcctaaaattgctttaaggtggtcaaactgattaagtttaataaaaaaagggattctctgagaaagtaatgtttgtggggaaacataagactgagtaggagagtgccaagtactccaggaggagccagggcttagaaacttaccagagcgtggcttcacaaggagctgccccagagcccatgtgcccagtgctcagaaggcaatgatgtgcgaggcacagaaggagcctgacaagaagcagggacctaattatgcagggcttcagagaccatgttaaaattttttattttatcctcaaagtcatggaaggatgggaggatgataaaatttcgttcttattaagagagccctctgatttagaaggggcaactgtatattcatcctcaggttttctgaaaaatggcatgactaaaagaaccacaaagtcgtagaagcatcagaaggaattctttacaagtcatcaagatcatcgatctaaaaccactttatattatccctactgaataaaattgtatcctgtttttaaatgtaggtttcaaggcacagaattatgtctatgtttatagttgaagcatcctcaggcattgaactggcaaggacatttctctcagtgttcccagaacctctgtctttccaggtgtagatgattcaaggttgagagaagtgcttcccagagagcactaagccctgggaagatagtccagggacgtaagccctggttgtctaggcaggaagtgcccaggtgttactgaaagctgagaagccttcaccactcacagcagcatctgcgaagggagaaggaaagtgacttagcactgcctgaagcccactactccaaacctcgtaagaaggggctgttaagcatgtccacattacaagcttatatcctgttccaatgtgtcttatacctcagaggacatattgccctccccttgtgcagatgaataattctcatgaatcatttggataatgagaataattagttttttcagcatcgggaaactccatttcctgacttaaatctttcattaccttactttatgtaagatttcttgtgtcctgaactaggaaaaatgcagaactagagaggctagaaaaaaagaacatcagctctagaaaaaaagaacatcagctctagaaaaaaagaacatgtgctctagaaaaacagaccatcagctgggtgtagtggctcactcctgtaatcccagcactttgggaggctgaggcgggtggatcacctgaggtcaggagttcgagaccagcctgaccaacatggtgaaaccctgtctctactaaaaatacaaaaaaagttagctgggcatggtggtgtgcacctgtaattccagctacttgggaggctgaggcaggagaatcacttgaatctggaaggcggaggttgcagtgagccaagatagcaccattgcactccagcctgggcgacaagtgaaactccatctcaaaaagaaagaaaaaaagaacatgcgtgtcggagatgggacgccaaccttcagcattttggctctagcattaattagccaggaccctgagagaatcactttgaacacccaggattcattgatattgagcctgaagaaatgagggatttgacctaatcaatctcttacagtactgatcttgtatgtccccttctatggctaaccacacttttaactcattctgtaaccatatgcattcaatttaaaatttcccaatcccttgtaactttccagagacatctcactttccaaatgattaatcttttttttaactttgtttttattttatttatttatttattttatttatttatttatttattttttattattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccacaacagtccccagagtgtgatattccccttcctgtgtccatgtaatctcattgttcagttcccacctatgagtgagaatatgcggtgtttggttttttgttcttgcgatagtttactgagaatgatgatttccaatttcatccatgtccctacaaaggacatgaactcatcattgtttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatgatatttccagttctagatccctgaggaatcgccacactgacttccgcaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcgaacattttctcccattctgtaggttgcctgttcactctgatggtagtttcttttgccgtgcagaagctctttagtttaattagatcccatgtgtcaattttggcttttgttgccattgcttttggtgttttaagacatgaagtccttgcccatgcaggctacagtaaccaaaacagcatggtattggtaccaaaacagatatatggatcaatggaacagaacagagccctcagaaataacgccacatatctacaactatctgatctttgacaaacctgagaaaaacaggcaatggggaaaggattccctatttaataaatggtgctgggaaaactggctagccatatgtagaaagctgaaactggatcccttccttacaccttatacaaaaattaattcaagatggattaaagacttaaacattagacctaaaaccataaaaaccctagaagaaaacctaggcattaccattcatgacataggcatggacaatttttaattatttaaaagatagagaaccatatacctgtttgtaccttaaaaaatttgtatgttgactggacgcggtggctcacgcctgtaatcccagcactttgggaggctgaggcgggtggatcacgaggtgaggagatccagaccatcctggctaacacagtgaaaccccgtctctactaaaaatacaaaaaaattagccgggcgggcgcctgtagtcccagctactgggcaggctgaggcaggagaatggcatgaacccgggaggcggagcttgcagtgagccgagattgcgccactgcacctccagcctgggcgacagcacgagactctgtctcaaaaaaaaaaaaaaaaaaaaaatgtgtatgttgtatttgtattacctattcaaaaaaataaaaatttttaaatggtagagataaatcttaagaataaagaaaaagaagacaattcaggaaactacatttggttctgtttttacagactcaataggaggggttgcaaagctatcaagacaagtgggagaaaaagaccaaaaagatcctgtctttgtgattataggatcattatagtagatcaaatatttggtcaattttttaaaatactgcataatgaactagaattttaatttcagaagtttgaaataaacttttaatttttaattgcctaaaaattttaattctatattatatttcctacttacatcttatatttcaaaaaatttttgccaaagaaagtttctggcaaacatttttgcttgcaggtgacttaactgcgtttttaagacagcacaattttgaaggaaagagagaaggagggcttaaaaaactataccattgtcatgtgggcattaagagtgtaagcttttggagttggaatagacctgatgattttctcattcaagtttaattcatgtaaaagatgtgtctcaaccccttgataagattacaggaaactcaaaggcaggaaccattaattatctccatatctgcagctataaaatattaagacagtgtactcttaaaaatgcttaacaagtgggtagatgactataaaagcttctaggagctgttcatggatggagattccagactttatctcaaaaaattttctcgacatcttaaaacctttccttaacaagtctttccattcatttaacccaccttctgctctcttgctgcaattaggaaccgtttgttcttattgttcttcaagaaagatgtagaatgtttgagcaacttcttcctgattttaatgtctttgcatttatgatacccatcacagtgttttacttaaattagcatttttggctttctttttttcttttgagacagagtttcacttttgttgcccaggctggagtgcagtggcccgatcttggctcactgcaacctctgcctcccgggttcaagcaattctcctgcctcagcctctcaagtagctgggattacaggcacctgccaccatgcctggctaatttttttgtgtgtgtttttaggagagatggggtttcaccatgttgcccaggttggtcttgaactcctgacctcaagtgatccgcctgcctcggcctcccaaagtgctgggattacaggcatgagccactgcgcctggccttaaattaccataaatggatgaatacttaatatagatttcattgccctttactttttttattatggttaaagaaacatataacatgaaatctaccttcttaaatttttaagtatacactacagtattgttaactgtatgcttaatgttgtgcagcagatgtctagaacgttttcatcttgcatgagtgaaactatgcccactgaacagcaactgccattcctccttgcccccaatgcttggcagccagcattcgaccttctgcttctaagagtatgactagtttagatacctcttaagtggaattttgcagtatttctcctactgtcattgccctttacttttacctcaactaaataatttagattcaatgtagaacacaaaattaataatagaacataaagaataaactaagtttttcacaccccattcaaacatcaaattgaataatatgctgaaagaataaggtgtgtgtttttacaactcttgcaattttaaacctgtattaatatatcttagaaatgagttgaccttgagctacactacaatgctaaactctcagaagcttataatcaccgtagtcctcagatctttcctaaggaacgtaacattttgacacagaagaatccttgcattttagcttttaacaaaatctcaagcagtctgttaaccagattaccatcagcatcatcagaaatggggaaaaggaaaggctttggtgggtggggcagggggttgataaaacctaagaatggagtgagaaatcgagtaaaactcaatgatgcctataggccatattacttggtaatacaaaaaaatagatatatatatttgacccaataacacgacatcaaaaactatatagtttgataatacttggacaaattttgaaatgatagatacatgaatttttttctagaatcaaatacaacaaactctgcatttgcctttgaagagtgagattattaaggggtattaggtatataaagggaattcgattataaagagaaacatttacactttattttatacttagtgtttaatttatttacttttgcacttattaatttgatgtataggtaaaaaattaaaatatttaaagctctcttcaatagacaaaaatgttttttttaaacatatcacttttacctacagttagtacttcttttgtttcagggtttaaaacataaaatgttttgaaacagatttgctgattttcattattgatggtctgaaacgtttgctcttagaaggatgttagtgaaggaggtttatcttatcaaattctatgagttagctactgcaatacagtagagcaccccaaaatttagttgcttaaagcagcaaccataattcggtgggtgaactatttggcttgacctcagctgggtggtttttgtggtctgtgccaggctaggctgaccacagctgggctgtctcagtgcggccatggtcagctgccaggatgacgaggaacgagtcagttagtctaggatggtctcttttggaagggcttatgtctgctccatatggtctcttcctcctacaggttagcacagccttgttcacctaagggttcatcagggttccaagagatggagcagaaacaggccaggcctctcaaggatttggctcagaattggccaacaacatcactttcaccacattctaggctaaagcaactcacagggccagcccaggttcaacggatggggaaatagactctgccactttatgaaggtgttgcagaggcacattaaaaagaggcatgtctacaaaggaaggaataattgcagccattattactaagaaatgtacaatacacggtcttatgctacccccaaaatttgtgaataaccaatagaatcactttgtgggaacccgaaatatatcacttttcttaacgtttgcccacataattatctttatactggtacaatataagcaattattcaactagtaaaactaattaatactctagatatagcttccttttaatgttaacagctaacactggctatgaagcatttgctctgtgccaggcaatgtcctaagcacagtatgtcatatcacaaaagtaggtggtggttagggtttggagtctggaccccagcttgctttgaatccctatgttagtatttattagctgtgtgaccttgggcaagtgaattaaccttattgtgcttccattttctacctataaaatgggctaataataaacttacataactcataagattgacatgatgattagatttaatctatgttaagtgctggtaacaatacctagtgtatagtaagggttatatagctgtcagctcttgttatcgtcatcatcatcatcatcatccccctcacaataaccgtgtggtggttaattttgtgtgtcatgcatgactaatacaaactctgtgaggtagcttctattattgtctccattttacggagaagaacactgaagttcagggagactgaccaaagtcacaaaggcaagatgtggcaggaccctcattcaagccctggcagctgtttcgagtctgggcttttcatgccctacaacactgccatgccacttaacagtaccttccagaatagttgtctacaggtcaaacatatacaggtcatgttcttttttcccccgtggttaacatttcagaagagctttattttccccactgcttggtttgcagctgagcagatataagaggtagctgtatgtacagaaagaactctgacatgcaatcagcttaactcctacatgcaaaatacagagctgcacacttgcagacatctcgttttatcttcacagataacccattgggtatgtattatccccattttatagatgaggacaccgagactgctcttgtccaacatcacaaagaatgggtctacctccaaagctttttctgctaggcagaattgctaaattaaatgtaaagagattctattgtaaacacttttgtaaagtgaatctgtaataatcataacctaatttgtttgttgtggaaaggtggagggtctcacttcttaaaagtgacttcatggttcaactctgatgaatgattctgttctcttcacttccagaggagatttgcaccctagttatcgctgagactttccctgaagatgcagggatctttacatgttcagcaagaaatgattatggatcagcaaccagcactgcccagctggttgtcacctcaggtatgtgaggagtaaaaaaaatgactgggttctgttccccagcaccagtgtggatggccacagcagaaaggcaccgtcctggccaggtgcagtggctcacacctgtaatcccagcactttgggaggccgaggcaggcagatcacttgaggtgaagagttcgagaccagcctggttaacatggtgaaaccctgtctctaccaaaaatacaaaaattagctgagtgtggtggtgcgtgcctgtaatcccagctactctggaggctgaggcaggagaatcacttgaacccagaaggtggatgtggccgtgagccaagatcatcccactgcactccagcctgggtgacagagtcagactccatcaaggaaggaaggaaggaaggaaggaaggaaggaaggaaggaaggaaggaaggaaggaaggaaggaaggaaggaaggaaggaagggagggagggagggagggagggaaggaaggaaggaaggaaggaaggaaggaaggaaggaagggacaaagcgactgtcccaggaagagagctcagctcagccttcaggaatctggccactccaggagtcaccctaacaatctaagttcatcgtgaaacaaaggctttaggggaggggagaagaaggagtgaagtggagatgacaaacaaaaagataatgatcgtgtagcaactgaacacacagggggctttctttaaaatcgtgcagtcttggtcttggaaacgatggagctggtttcctaacatcctcccgctaacctagaatcatattcacattggaaagccacctctgcatcagaggtgcagtcactttctcagcagtgccaacacatgagatctggagatacttgtacaaataagccattgtctgatccactgttgaaacttctgaaaaggtaatacaagataagccttcttgtataaaatgtaatacaagataaaactcagagaagctgtaaaggccttcaaactcaaatttcactgatagtctgtatcaatgatagtatataactaatatgaaaaagaaagcaatgtattgtattattgaagtcaattttcaaaaatatatggatattttctaaactcaaaaacttaccactagggaaggcaatatgaaacagctttttttctttttcttttcttttcttttctttttatttgtctgttttctagttactaatgagcattagcttactttaattgcctcatctctgccattcatcttaaagatatttttaaaatatgtttttgaccaagcctggaacataatgtacatagtagggaatcaataaatgggtcatttgttaaatgatacggacttggagagaacaactgaattgtacttggattccttcagaagagcaagaacttggtgctaggtggcagcagagacacaaccaaaacttatttagggaccttagagtggcaactgtaaatgctttttcatcttcattaagaaaagaaatgggagggtcatcttaagtgggaaatggtttctgtgaatgactactgtaagtgctgaaagaaacctaagtgtcaggatcagagttacagagcaaagaggaccccagcgttttgattccgagttggcttcaacactgtcccatcaaatggccatagcaggagtgcagtgtttaaacaatatggccaaaaccctgggctctataagtctgagtggcaaaaatttgtgtgtaatattttccatttgtttctgcagtaaatctgctataggtcaaacataatcaacaaatattttatttctgagctttttgtttacctcaataagcatttttgagtgcatgccaggagctctgctgggctgtgtgggcaaggtgcagaatctaaaaaagacgtgatctcaagatgctttcagcctattgagggcaacaaataaaaatctctttcgtactgagttatagttggagcaatcacctaatatggaaaaaaatatttttatgagattatgaaattttacttggactccaaggtttaccttccctagctttagatgaatatccacataaaacctttacagcttgagccaatttgagtagtgacagctaggatgttcagtcggacccatggaccaaaacgtgagaggacaaagcattgttggttgatactgtttgtgttgtcactttttttgccaagttctatctttagctcttgtttggaatttttatgattcggtagctgggttccccaaatgtgagctcagtcaggaaatgaaacggtagcactcgttcaaaacaagcttgaaagaaccaggccctccagctggcagtgcttctgcgtcagatgagagcagcacaatcacctcttctttaacaacttcacacaacacagggattctcagaagactctgacagtgtgaaatcacttgttgaactagtggcatcttcttatgtttttcctctctttccccttccttagccaacactgaaaactgtagttacgagtcaatgggagaatccaacaatgaccacttccaacactttccacctccccctccaatcttggagacaagttccttggagttggcttcaaagaaaccatctgagatccagcaggtgaacaaccctgagttaggcctgagcagggcagcccttcaaatgcaattcaatgctgctgagagggaaacgaacggagtccatcccagccgtggagtaaatggactgattaacggcaaagctaacagtaataaatctcttccaacaccagctgtcctgctttcacccactaaggagccaccacctctgcttgccaaaccaaaactgtgagtatttctgcatggttttataataatttccatacccctgttacatttcctgtctggtgagaaaaaaacttttgcctgtattcaactatgtggcaagttggccttgactcatgggaccttgctgccaagtggtgtctttcaacaatataaaagacacctaaaaataaagaagggaaatgaaaagcttggtgaaatctgccctttgctgaaagctataactggttatggctgtgaaaatatctgtgcccagtgtgggcttccaacatacagctaaggatgtagccactccctggaggccatggaaaagggggatctactttcagccctttattaaaagcatttcaaaaagtgagtataagtactttgcatttgttactttaaatattaagtatcagtaagaagatctgatatagacaagcggggaaagactaaaaactgaggctggaaattcagggtgcagatcctggcagggcaatgaaactggagggaagcaggcttgtgggcaagaagagcgcccttcacaacacaggctacttggcttggaattccatggagctgcatatttccatgaataccatcttcacagttgatgtccattattttcttaggatgataaaccttgcatgagctgtttccattggcaccgcacagcagagagttgttatgaatggagccattacaatgtcagagagaggcagaaataaattagctcaaagggttctaccatagcgcaagagaccctgaattactgccctgccagaggttagtggaaatgtaagagtcatagtgaatgtgtatgtattctatgaggtcacattcccatgagaatgtatttgccagaacctaggaaagccccttctatttacccatatctgatgtttttgatttggggcaggaagggcttctttaggggttattctttatttccctagcattgactagcctactcttttctctctgtgatcagttcatttgttagaaatgttagaatttaaaagatatttgaattagaataacaccttacctttgtacatcactttattgtttactgagtgatttcatgaacaacattagactaatcaaataacaaaagcagtcaaaagaataccttaagttaagaaatgggctaacaattatataaaaccagacttctggacaatcttgggttgcagtttcaaaaatcgatatattgctaccctctacttaattttgcattgtgttctggctctcttttaagacagtagggctactcactaagcttgtacacaatagtgtgaaaggtgctggtgaacatttaatacctatgcgccatctccattcagaggctgaacaggtataatgagctaaaaaatggtgtccttaaaagagatttatgctcttgtagcagcaacccataaaattaattgccactgctgacttctttcatctttgcattttgaatatgtatttgcagtgcttttaatgaaacaagggacctgctctccagggagagaaagggcaaatgtgttgaatgactaggacttgactgtggtcttgattaagtaaagtctatctactctaatgggtatcataaattggatgtaaatcacaggagagcaaatacgaggagctgttaagaggcatctacagcccgtcttatctcaggagtttcaacagctctgcagcttttagctctgctttgcagccaggttaatgtatatggcaagggggtaatatctacagaatgtagacaaaacaacttcgcgttcattaagaggatgacagcttaagcacaagtttaaagaacatcaggatttgcttgtgagtgagataaaatatgaatatatataaatatataaatataaatataagataaaatataaaataagatgcagaaaaaatggacttaaatgtatgaggcccaaataaataggttactctcccttcatgaggaaatttaagggaaaaagcagaacacctaaccacaaaacccaacagcttagaaacaacatttacttgtactaggttttcccattgttttttttttttttttttttttttttcaaatcttcgtatgtttaaacatattcttagggaatcacttgatttttgttttttcgtgttgcatatttacctgccatttaactaggtagaaaataatatgtgatgatactttttaaatatatatttttaaattttcttatgatttagaatatgttattggattttgttttattacaaaatcagtggatgcttgatgtgacaattcaaacaacacagaggctattaaagtttatactctctgcttcccttcttccaacccagccctctgaaagttgtggtatggtgtattatcagagccttttctaaaaaaggtttttgcagtgttttcaaagttttctttcagtgtttgttcagttttcaaagtgctctttgcttccccatttccacccctctcaaaggtgtgatattctgtattatcacaaccttttctaaaaaatggtttgttcagtgttctcaaagttgtattattgatagagaaatactattgaatgacatctacaaataatgtagaacagcatctgagttattgataatgaatgactataggtaactgccaagtgaaattcttacacattcatttttttcttttcatacattgtgggaaaatatgagattttatttgcctcgtgtggtcagcaatgaaaaactatggtttgctcaaatcttcttttcatcggtttatgatttgattttctttcacaaaaggaaaggcttatatttggtggcgttatggcagtttgtgcatctccatcatttgtaaacaaactaataggaaacaattcggagggcgcaagtaataggaactaaaatatttactctcacaatgaattaatctgaaaatggtgtctgatgtgtcagatgtctgggggaaagaagatcattttcaaaaaaaaaaagaaaactgcattttttttctctcttgaatagctccaatactgattgcgggaaaagaaaaaaaaaattcaagaatgaaacaaaaacctggaagggccatgagctcttttctctaactaggcccagcccccaccctgtactgtccaacagaagtcgtcacctatagactcacagccatcccagacctccagccgagtctgtggtaccgctcataaagtaggggttcctggtccagtctatgatacctctcataaagtaggggttcctggctcagtctgtggtacctctcataaagtgagggttcctggcccagtctgtggtacctctcataaagtgggggttcctggcttagtatcgtggacgcatccacttcagctcctacatctccctttgtttctaacactctccctcaagtgtaagcagaagatagttaaatgtaggccatttggtgagtcccagatgacctgcacacaggatttgtgcaacgccttaccacccgctgtgggactgcgaagtgtgcttaaacgctgcacaagaaaaaattaatagcattatttctgcaactcagtggctgacactcacaatcttcaatcacatcatgaaagaagcaacacaatgcttaagtcataatcttaacaggaggaaaaaggagggaatgagcgtaaacctaacttatacactattcttttccttggttccttgctgccctctcattacaaatgatatttgaagatcaaaataaaggtagggctcactgtgaaaaatctctgcttctctttattcctaccaaaaaaacggtccttcagccagggcgcggtggctcacccctgtaatcccagtactttggaaggccaaggtgggcggatcacgaggtcaggagatcgagaccatcctggctaacacagtgaaaccccatctcttctaaagatacaaaaaattagccgggcgtggtggcaggtgcctgtagtcccagctactcgggaggctgaggcaggagaatggcgtgaacccggagggcggagcctgcagtgagccgagatagcgccactgccctccaccctgggtgacagagcgacactccatctcaaaaaaaaaaaagtcaaaaccatagacatgcatggaatccccctaggaataagctctgaagggaaacctgtgaatggcaaaatgtggtaggcgatttgccaagcatatagaaaggcatggtcatgtttttccactgagctcacctcctacggcagatccaacaatatataaataacaatatgctgttttcaaatcccctttgttacttccttttttatcttcttcctttgtcttgtgggagaaaggtaggactctaagcctgtagacgagcaaaatgagaactccaaagggaggttactgaagggtgatgcgatgggcaagttcttaccctgggacagatcagcagataaaatgatgcttatttgttactctagtgccaaaaatatgtgcattaccgtgaaagtctgtgtccttttgcctgggaaaataataatgaaatgattgttaagtgtttacatgctaaatcaacagctccccttgctcctactcttactacttgctcttaccccagtctctaaagaagaaacagtattatgattttctatcttaaaagagtaaaacgatttcaggctgaatcaaccttttcaaaattactgcattttacaacctttgcttttctcttcctttctctcactcccaccctttgataccctattgttctgcaaatcctgtctccagagaaagacatagcctataaaatcattcatattgagctgttagggattgttagcatcacctcagtccagttctaggctaacaaagtaaagtacatcttaataagcaataataagcactgcacaaaatcaggaaaatatcatttcatgagatgatgtgtttgagagatagaagagaaggaaatagcagcctttatcattctctttattagtgaggttttccatatttggaaattcctgatgggtttcctccacactcctagacacaaattgaagtacaagttgttcccttgcctggaatgttccactccccagaatgttctgcctcttatggctggctcttacttgtctttcaaatctcagcttaatgtcaccacttccctgaccacccagtctaaagcagccacccagccatgttccaataactcatcctcattaattatcgcataccacataattatttccgacagttacttgctttttgttttttttaattgctccctgcctccaatattataatgtagcttcctgagaatgggaaccctgactgtcttatttcattgctctttcactaggaccctagaacagggcctgacaaatagtagatgctcaacgatgttttttgaatgaatgaagcaaaagcagaacaaaaaagaggaaaagaaagatctcccacctttagagcaacccccatttgatctgcctaacgttctttttttgtttttttgtttttttttgagatgaagttttgctttgtcacctaggctggagagcaatggagcaatgatgtgatcttggctcactgcaacctccacatcctgggtgcaagtcattctcctgcctcagcctcccgagtagctgggattacaggcacgtgccaccacccctggctaatttttgtacttttagtagagaccgggtttcaccatattggccaggctggtctcgaactcctgacctcaggtgatgcacccacctcggcctcccaaagtgctgggatatcaggtgtgagccaccatgcctggctgatctgcctttcacctagatataccataggacttctattttcaaaccccatcaactccagagttttcccacattacagtacttttccaactgacatcatttatcttgtaaaccaaatgagtatgaagaattaaataagaatctcatgggatagaattacattagaaaagtttgtccaagttacttaatttgggaacactttcaactccttcctcatttcttctgtgttctcatttgattagcatcttaatttaaaacattatgaaaaatgagacattcggaaggactaggaggacattttcactctctagtacatacttgcaatgtcagttggccacagtgcaatcacactgctatttcaaggtgtgtgtacttgacatgttaacaccccatcagatgccagacttgtggtgaagggccaagagcttctgtgctactcccttcctgtcctgtttatgttggactgcagcttcaactccaacgtgtggctttggcaatagaacttacaaagttgaacattatcccgtccttcaacctctactagttagggttcaagatctcactatattactgtttgacattagtatacaaatggtttcttaggttctgttcttgtataaaccttacctggttgattgaaaagcaaagcaaaataaaaacaaaaaggacaaagacaaggtaagcaaaaacaagttgggacaaaataactaacaaagggtcaaggaaatgtaatcattgaatgtacataaaagtattttaaaatctagcacacttttttttcttaaccaatatttctaattttttacatgtctgcaacctgtagacttaaatcatccgtaatttccatggaatttcatgtatgttcagttagctagccattactttcatttcttttcaacttaaatttgttttttctaggtaatacaatcacacagttaaaagtataaagaaatatatgcactgaaaagtctgcctctcggactcagtaaccagttgtcactgtcttgtgtatcctgccagagattgtttacatgcctatcaagcaaatatatacgtatatataaaatgtgtattttttcttttatttttagacaagtgcctacccaccacatatactgttctgcaccatgccttttctatttagcagtagattttagagatgtttcatgtgagtaattaaaaagtcttatttttaagtgattgtatatatttattgtagaaatgattgataattcctttctctattgttgccaatctaatttttttttttttttttgagacggagtctcgctctgttgcccaggctggagtgcagtggcatgacctcagttctctgcaacctccgcctcctgggttcaagtaattctcctgcctcagcctcctgagtagctggaattatggacgtgtaccacaacacctggctaatttttgtatttttagtagagacggggtttcaccatgttggtcaggctggtctcaaactcccgacctcgtgacccacccgtcttgtcctcccaaagtgctgggattacaggcgtgagccactgctcccagccaccagtctaagtttcaatgacctaagtaattatcaaaagtaatcttctttttttttttttttttttttttgagaaaaattctcgctctgtcacccaggctggagtgcaatgacacaatctcggctcactgcaacctccgcctcctgggttcaagtgattctcctgcctcagcctcccaagtagctggaattacaggcacccgccaccttgcctggctaatttttttgtacttttagtagagacgaggtttcaccatgttggccaggctggtcttgaactcctcacctcaggtgatctgcccgccttggcctcctcaagtgctaggattacaggtgtgagccaccatgcccagccaaaagtattatttaaaaaagtttttcttacttgtattttaggttcggggatacatgtgtacgttagttatatatttgcctgtcacaggggtttggtgtacagataattttgtcacctgggcaataagcatagtacccaatagataatttttctgatcctctccctcctcccgctctccaccctcaagcaggccttggtgtctgctgttcccctcctagtttccatgtgttcttgttgttaagctgtcacttctgagtaagaatatgtggtatttgtttttctgttcctgtgttagtttgcttaggatcatggcctccaactttgtccatgttgctgggaaagacatgatcttgttcctttatatggctgcatagtattccattgtgtatatgtaccacattttctttatccagtctaccattgatgggcattaggttgattccatgtctgtgctgttctgaatagtagaacaccattcatcccctcactgttagttgaacatctgcaaaatgctgggtaatgtggggtgctgaaaacacaaagatgaaagagacaagagcagtacctttgaataatctataacctggttatctctacgatgattttggcaagaacgtgcagatgcatacacatatacacaaaatgctgcacatctttcagcatcatacaaattttgtagaagaatggccaatccctaaattagattcagtgcaacccaaatgccttctcttcccactttaatgtttgaaagatacatcattcagtttttgattctgaagatttaatatgcaccagcttttgtttctggttaagtgattttcattatcctcgaaggctagtcaaataacaaagcaatttagtaatggcaaaagcataaagtgtggaccagaggggtcttcaaaatattagggaagatagagcagaaaaccatttttttcagtttgttgttataaaattatacacacactctgagtcaccaaacacattggaggttgataaggaacataggagtagtcacgggtcctaattctgcagtacgtggctatgcgggtatgaactcttcataaatacaatgtgatgatgactttgcatttgcatttctcttcctcctttctctcactcccagtcttagatacccgattgttccataaatcttgtcttaagagaaaggcatatcctataaactcattcatgtgaaggtatttgcattagcagtgttggtcttggatcactttgcaaacaacccttccctgaaaatgagaagtccaatcaaggagcttcctgaagtataaaacttttttaactaagtaataacatttaggtgcattcatcctcatgattttttaatgtaaatactggctctgacacagtgccacattcttagatattaggctaattgtgctttgctgtgccagtctcttggtgaatgtaatgtttaattacatttccagaagaaagctgagttctatttttatgattaggagttttatttgatgtctgaaatataattggaaatacttgcagataccctatctgtgtttgaagtggcactcaatcatccataagaaataccatatgtccatttcaaatattaggtgttttacatgaaggaatacatgatgataacaatatttcttcaacatatcttcattttacctaagtgcgtaggagagctcttttagtaattacaaagtaaggtgaaaatagtcatccctactgggtagagaccttttattttaaaagggggagtggctaagctcagagataagatggagccacatatgaacaatatgctcatagataaagctatgaatttgatggaaaatatgaacaatatagtgttaagtgaaaatagacaaaatgatatatgtaacttaatgtcaattttatgaaaaaataaaaaataatacactttaaccaactaaaatgtatattatatattagaagaaaatacaccaaagtgtaaccagtggttctttgagtgctggaaatttgggcagattatatcttctcattaactattcctgattttccaactttttgacataatgcttttataattacaaagtattattttaaaataaataggtacttttgatcctttctcttccatcctccttcctccattaaacttcagttcatttgactgttcatcatggatgcttcttgttaaataatagttgcttgctaagtaagcttaattttgagcacattcagaagtggaatgctctggcactgaatgttctcacctcccgtgtgggatctccttctagaaaccaatgaccttcaggattccatctggatttttagaactcttcctaggaatccttccccagaaaatgtcctatattccaaaataactttactcctccacaaacactgttttccaacaacacctgcccccaccaaacaaaactcttatccctttaattgtacatctcaggtgtttaaatgaatatgatatgaataagctatttatgtatatatgtatgtatgtattttcaagccagggtctcactctgccacccaggctggagtgcagtggtctgtcacagctcattgcaaccttgacctccctgggctcaggtgatcctcctgcctcagcctcccaagtagctgggactacaagtgcacaacaccacacccagctattttttttattttttgtagagatggagttttgccattgttgcccagccaggtctcaagcaatctgcctgccttggcctctcaaagtgttgagattatgagacgtgagccaccacacctggccaattttaaagttaaaagtaaaccaaatactttaaagaccaacatttacagtataatccatacaaggccttccacagaaagtaggatgaaaactttaccctcagagacaatggtgaaggagaaaagatgcaatgaaggcaagactaagattccaattcaaataacaataatgtcaggaaagtatgcgatgaaggcatctgctgaaagaggaaagacagttgtggtaactgtgggtaatattacaaagcacgaaaagggtggagaactaagagagagaaagaataccaaaaaaggaatgtgtatatttcctggcaatcaagagaacccatttgaatttcaagagtgtaaacccacattcaattcagtgagcatggtttcatgactttatttcagcaataatgagcactgtgaaggtagaaacaggacatatgtctttggcagtactggcacagtgggatgttatggtatttaattagatgatccttgagaaacattactgagattatcagccaagccgtgtgtaggttcagaaaaggaaacagattcaacaagattaaggcttgaggggaaaagagaaaggaatcaagaaaatggaagttataccaagaatgaaaatggggagtgtcagatgagaaaatatggagagggagcagtggttgtgatcaaagagaggattctgaaagtttaaaaaacttaaactctttccaagtgataaaagaatgtaagatgcatctgttcgagtggatagtttaagtggaagttaaggtcgcaggagcagaggaagtggtcagggaaccatgaagccaggatgttagaaggaacattaacatggatggtggccaacagtgatggcagaaaaccaaatgctaaatagtaaagtcactgagaaaagtgaggaaatgaccaaggttgttggtgacaagcagggaagacagaatgactgtaggtggagtgcaccaacttcaaaagaggaacagatatttcgtagtgatggcaaaactcttctgagagttgccttgggaaacaaggaccctgcagaaccctccttgctcagaaggatactgaggaggctggagacatcatcagggacagccagacttcagttaagacaaagcatttctaaggaaaaggtttgaggaagcagagtttggttagaaacagccaaggaatcccataggcaatagaagagatctagaaaagggattcaagggagaattggagaaggaagatgaggaggaagaaagctatagtgcagagttttgcactacgaacctctggatgctagagcagatacagaaattctgtgtcagcattcctactgtgttgtgctagagcacactactctgtaccatctgatgctgagaagcaaaagcatcgtcctgaggatcacttgctgctatttcatgaagagtgactaagattacttgcagttggaaggaaatagagccatttccaatataattactacttactttttagcctcctatttattttagttacgtggtagcaccatgatccattttgtggttactaacctctaagtacgactttgagttgggcttttttttttttttttttttctggtggagtctcactctgttgccaggctggagtgcagtggtgtgatgtcagctcactgcaacctctgcctgcgaggttcaagcaattctcctgcctcagcctcccgaatagctgggattacaggcacgtgccaccgtgcccagctaatttttttgtatttctagtagagacagggtttcaccacgttgaccaggatggtcttgatctcttgacctcgtgttgaattgggtttttattgaacaagcccaattcctcatttgtgtattttaaaatgattgttctcaactaatgactctctaattcatatttgcttaatttcattttatgtttacaacttttactactagagaatttatttttgtctactacaggctgaaatacattaggttgacaatttttttaccattgatttattttttctgcaaatgtgtgagtttttcattcatactaatacatcacctaatagtgagaacattagttacagggaggtttattttaattggtttctattacaagtatgaaaccagagagttcattttctcaacaaatctgagagtgattgtttccttacctgactaaagtgatgattacacaaaccttgtggatgacagtggagtcaatgtggtttttaaaaaaccttttccatatgtgacaaggaattagatagtatgtcatttgattttaagaatgatgaacatattaaattgattctgtcaaatgtagatttttctaaaataagttggctggataaatcacgtcaatttgaacacacacatctttgcttcattattcaaagagaaaccataattacgatcagaacctcagattttgctctaggagcataccaggttcatgccttccaacctctgtatgtgaaggtttcctggtaggatgatactggctcctcttgcccaaggctgtcatgaggatgcacactcactgcaagggttttttatggtgctgagaggaaaggccttcataaatatgtacatttacttaatttctgtatctacattcccactgtgttttcctagagctcactactgtacaccatctcgactctgaagccctgggaatgtctgctctatgctctgctccatttcacaatgttctttaggtctgttttgttatttaaatgtaatgatgtatgtatccacaataggtagcatttgagagactccagctgtgagcctctggatgtgaagctagtgaaacaattgaatgactaacagttgaatgcctagccaaatattttcacttcactttatatgtcagcaatggaaaagagtaggtgtagccatcgactcttcttttcgctcagagaagtttataaataggtcaaaaatgggtaattatatgcctcagctacaatttcaaacttctgctttcctagtaattgccattaaatgagtaagttgtaaaagatttctggaaagaccacaaatattttcttttccttgtttctttgttaaaatagttcatataccatctggtttcggggatgtatcattatgctcaatgtttgaaacaaaaaaaccctaaaagacataaaaggtggcttgagtacaatgcagtgaaaaagaacaatatattttattctctttaatttcttttttttttttttttttttttgagatggagtcttgctctgttgcccaggctggagtgcagtggtgcgatctctgctcactgcaagctccgcctcccgggttcacgccattctcctgcctcagcctcccgagtagctgggactacaggcacctgccaccacgcccggctaattttttgtatttttagtacagacggggtttcaccatgttggccaggatggtctcgatttcctgacctcatgatccgcccgcctcggcctcccaaagtgctgggattacaggcgtgagccaccacacccagcctgttctctttaatttctaaaataaagttttagaaaaaactaaaactctaaaaagagtagcttagtcttccaaacagtgctagttacaggggcaaattcttgctccaggtgactgtttttatgtgccttcccttccctcatagccactgctttcttcaaagggcatcctctaactcaaatgtgaaatattcatgtgtatttttattctatcacaaaacaattttacacagataggattactcatgatgaagcattctagaacaacagcaagagtttcacttcatgtttgttgtaattattctatctttgaaaagcagaaatatatgtggttattatcataattaagacttcctgatactgaacagctgccttactggagagaaatgttaggaattttttatttttactaaaaactgtcagaagtttctaaaaggaattagatgaatcctgaaggtcctgtaacttgaaaagttgatttacgctgaggaccccattttcatcaaggtatcaactagagagaaacttgtatttttcttattttgcattacaataatgcatcttgcttttcttttttatgaagtgttcactttatttttattactccaggtacccaggatcattcatgctctcttctttaaggtgttgtacaccttgtgttcagtagacatttttaatttttttcttctctgagacaaggtctcactctgttgtccatgcctggctaatttttttcttttttgtagagacagggtcttgctttgttgcccaggctggtttcaaactcctggcttcaagcgatcctctagccttagccttccaaagtgttgagattataggcatgagccaccacactcagcccagggttcagcagacactttgagaggtcagatagagttcatccttcaggcagatgagatgctgtccctttaaaaaaaaaaaatcaacttctattttagatataggggatacatgtgcaggtttgctacatgggtatattatacccatgtagtgaatgtagtatccaataggtagtttttcaacccacagcctcctccctttcttctccttctggtagttagcagtgtctgtcatttctacgtttatgtccatgtgtgctcaatgtttagctctcacttgtgagaacatgcagtatttggttttccatccctgcattaatttgcttaggattatggcctccagctccatccacattactgcaaagtacatgatttcattcttttatatggctgcatagtattacatgatgtatatgtaccacattgtctttatccagttgaccactgatgggcacctaggttgactctatgtctttgctactatgaatagtgctacagtgaacatactagtgcatgtgtcttcttggtataatgatctattttcctttgggtatatacccagtagtgggattgctgggttgaatggtagctctattttaagttctttgagaaatctccaagctgcttttcacaggggctgaactaatttacattcctaccaacagtatgtaagcattcccttttttccatagcctgaccagcatctgttgttttttgactttttaatagtagctgatgtgacatggtatctcatcatggttttgatttgcatttctctgatgattagtgataagcattttttcatatgtttgttggctgcttgtatgttttctttggagaagtgtctgttcatgtcctttgctcattttttaaatgggattcttttttatctgttgatttaagttccttataggttctggacatgagacctttgtttggtacatagtttgctaatattttctcccattctgtaggttgtctgtttacactgttgatagtttcttttgctgtacagaagttctttagtttaattagatcccacttgtcaatttttggttttgttgcaattgcttttggaaacttcaccaaaaatgatttgccaaagctgaggtcaagaaggttatttcctaggttttcttctaggattgttatagtttgaggtcttatatttaaatctttaatctatcttgagctaatttttgtatatggtgaaaggtaagggtctagttttattcttttgcatagggctagccagctatcccagcaccatttattgaatagggagtccttttccccattgcttgtttttgtcagccttgtcaaagatcaaatggttgtttgtggctttatttctgagctttctattgtgttccattggtttatgtatttgtttttgtaccagtaccatgctgttttggttactgtagcctagcagtatagcttgaagtcaagtaatgtgatacctccaactttgttctttttgtttgggattgctttggctatttgggttcttttttggttccatatgaattttagaatagttttttctaattctgtgaagaatgacattggtactttgacaggaatagcattgaatctgtaagttgctttgggtggtatgggtattttaacaatattgatctttccaatccattagcatggatgttttttcatttattcatgttgtctctgatttctttcagtagggttttatagttcttgtagagacctttcacctccttggttagctgtattcctaggtattttattttctttgtgaatattgtaaattggattgtgttcttgatttgactttcagtgtggacattactggtgtatagaaatgctgctgatttttgtacattgattttgtatcctgaaacctttctaaaattgtttatcaattctagtagccttttggtggagtctttaggaattttctagatatcgaatcatattatcagtgaaaagagataatttgaattccttttttccttttggatgccttttatttcgttttaattgtttttttattttcccataagttattgtggtacaggtggtatctaattacatgagtaagctctttagtggtaattcgtgagatcttggtgcacccatcacctgagcagtatacactacaccatatttgtagtattttatccctcgccctcctcccactcttccccccaaggccccaaggtccactgtatcattcttatgcctttgtggatgccttttatttctttctcttgcctgattgctctggctaggacatctgtgtcttgcctttctaagatgaagttctgttttaactcttggtgatagtagtaaatgacctaaataaattaggtccaactaatttagtaagcgacctaaataaattgtgttccaactaaaatgggaagtgaaatggataaaaagaaggtacacgttttaaattttgtccaatttcttggtctttttagtcagaacaaaggaggaagacaccagctgaattcagttctagggttttgctaggtactacatcatgggcaactactgtgcttttgctttggatctcaacctcaaactcctgggctcaagggatcctccaacctcagcctcctgagtagctgggactataggcatgcaccaccatacctggctaattttttttttttttagagacggggtcttgctatgttgcccaggctggtcttgaactcctgggctcaagcagtcttcctgccttggcatcccaaggtgctaggattacagatgtaagccactgtgcctggcctgggcatcttcttaaacattgtttttctcatgacattttcctgctccaaaagtagtgcctcttaaaggcaggaaaactccctcccggaattccccatcattcattccacccttgactactgctccctaggatcaatgcacagttgttctcctaggacttcccttcaacatcattctcgtgtacttttaccctcttcttctcctggctcccttggttcctaagtgccatatatttcactttttattttatcgtctcatttaccagaagcacattctccagtagcttccaaagaaagggtacagaccacattaagcttctagaccctgcttgtctgaaaagtgtctttattctagcctcacactaaactgactgtttggctaggtttaagagtatgggtttttcctaagaacgttgaaggaattgcttcatattctagttcctagagttactgtagcaaaattcagtgccaatctggtttctaatcctgtatatgactgactttcattgtaaaactatctcttcacccctagtactttgaaatgttgtgatgatatgtaatatttttcagaaattatagaaaatagtgggccctttcaatctgaaaacactcatgtatatacattctgaaaattttcttatttttaaatttcttctccattttccctgttctctctttgtgaaacttgtattattacattaataaaactcctaattgatgttctcacttttttcttttgttgcctatttttattgtactttctttagacctcttcacctttgtcttccagaccttctgctgaatctgttatttctgctattgtatttttaatttccaagagttctttctcattctctatattctttcatggcattctgttctgtctcatggatgcaatcgtgtcctttgcctcatattaatcattggattttggaggagggaatcctattgttattgtcattttgttttgttttgtttttcccctgttccctgcattgtctctatttcttaaaattccttttttttgttgttgtttttctgtgtgtgcatttggactaaatttcatgttcgaggctttccataaacatggaaagcgtgatctttggcaccagcaagttgattggaaactatatgcttagctagaatgtgtcaatgggcaggctttaccctaggattgggcaagacccccaagtgccaatatcttcaggtcttgggttaatcagtttctctagaaagacagatattcagccaccttccttgggatggtgggggtggttgtgggggcaggtaacatgcttggcagacagcatttggagcctgagtaagggaagggggttggcttttatcatttagtagacatatgcatccatctaattccttacccccatttttcaccctcttctcttacctgttcattctgctgtgccagatgtttccgagtttgaaacccttttggctctccatctccataaagtgagctttctgtattctagagtagtagaggaggaatggttgactacctacaagaaatgggggaagggattcagctgccttcctacaaactttcagccagtcttcttgtactaagctccattcctcttccccaccttcagaggaatctagtgatcaaggtttctgctgctcacgttagcatccctcatgtttgattcactctctgtaggcacttgggttttcctctcctgataagtcagtgacaactcatccttttacttttaattccagtgaacttacagtttcacaatccgttgctctcagttttttcacgatgaagcaaggaacaaaaataaacacatccattcaatctgccatctttaagtggatgtcaatttatgagacttcacagcttgtttttgaagatgattctttccagctaaagaaagcagtataggacagacagaatctcccctattcccaagctagatgaccttagataagctactcagtgccccatttcagttccctcttcattaagagggaatcgtgacagtacctacttcacaggagtgtggtcacgtgaaataatgtgctagcacagggcatgccaaagggcagatagtccaattgatattatctgtctttgtttttgttattattaagacaatgttcacaatgaatcctttgttatttgacgcacatatagaaagtttcagaaataagcaatttgcaaaacttgcaaaaaactgtaagtgaattattcctctgctatgctgagttttcttcctccaccttcaagaagtggcaaggaaaaaaagatagaaaaatcactgaccaattagaagtttttgtttcaattcagaccaccctaaagttcctggaaattgcatatatgaactctagtaagctgaataccaaaaatgagagggaagtagctgataccaggctacagattgtgggctacaaaagattgataaacaagtggttcttttgtgcaaatttagatatgaaatcatgcagaaaacacttaacagaccactagacagaggattttatgagacatgttacacatggatggtgaaaggctgaaaattaatacttaacttgtcatgctttctgctttgaaatgctggagccctccaggaattttgttttaacaaccaatggagatatcattagggagatacttctgaattcgctgcatctcattctgtgacaaagtgctgcacaaagtaaaatgtacctaccactttcatccgagtttgtagcgttggacaaatccctattccacaatatcatgtgtacaaagagtttccgaagaacttgtggcatatttcttgtcagttctcttgaagttctcatttccccttttcctctcctacgggcaggtgattgattgacttagagtcagtgctgagtagtaaataacttaaaaaacaaatctagagatgatctggagaaggctcgaagaaatgtgatatgtattatctgggataggcctagaataacctgaatttacaatgaaggagcccagtagccttttctagaaagccgcttgctcttccactcttgtttcctcttaggcaagagaatatcactagaagctcagaaaattcaggattgattggaaatgtttaaaaagtgaaaataaacacaaatatctataaggctaggaacataaccagaaaactcagaaaaacataggggcttaaggatgttccaaaggtaaaaatgacctcaaagtgaatttctttcttttctaatctcgacgtaattcagttcttattcaagctgagactacccaaagacaaaaatgttgcactgatttaaaatatgactcatcagaacattaaaatacttatgatacagatttttatacaatccgatagtctattcctcacaactcattatttgctccctttaaaatatttcacaaagaaagtcttaaccagaacatgatcatgtaactaagagctccacattcagtagtaggataggtcagaagacttacagggatgttcctcatgcttacaaaaagaaatttgatattgtgtgataatacacgtaagctagaaacttgtggttaaaagaaatgtttaggactcatgtaagcataggttcttggtatctttttttaactgatatatcatagttgtcattttggggggtacatgtgatattttaatacatatataatgtgtaactattaagtcagggtaattgagatatctgtcacctcaaacatttatcttatgttgggaacattaaaattctcttcttttagctattttgaataatttattgttaactataatttccttactcttctatcaaatcctagaactttgtatttttgtacccattaaccaacttcttaatttaacctttaaataaaaatattttcattcctaaccctgaaattctacaaatttactgcttagggatgactcctgcatgttttctcttccttttaagtagacaagttctaaatcttagctgactttcattagccatttgactaatcccattttttaaaagtgtttgagatgggttgaaaaatatgaccaatgtgatgagtacaacttgatcataattgtaaaatattagtgtgctttaggtgttagcaattaagaaaatgtgaaatgttttatttcttttctttccttcccttttttttgaggggcgggggtgggtgggtagagacagggttttgctttgttgcccaggctggttttgaacttctggcttcaagcgatcctcccaccttagcctcctgaagggctgggattacagaaatgttttttgttgttgttgttggttttgttttatttttttgagacggagtctcgctcttttgccctggccggactgcagtgggtgctatcttggctcactgcaagctccgcctcccaggttcatgccattctcctgcctcagcctcctgagtagctgggactacaggcgcccgccaccgcacctggctaatttttttgtatttttagtagagacggggtttcaccatgttagccaggatggtctcgatctcctgacctcgtgatctgcccgccttggcctcccaaagtgctgggattacaggcgttgagccaccacgcccggccacagaaatgttttaagtagtaacatgattgttaaaatctcaaatcctgagtatctgagatatcggtttgatacttagaaaatcatgagctctggaatcatttttcaaatgcctatctaggatttgaattggcatcttaattagtaacatcagtgttaactatggcaactcatttgtttcccaaaaaaatttactattttaaggttaaatataaaataacggtataagtcctgggtttgatttttttttttttaagtgtaaaaagttatctgtgttcagtaggtggagaagccagctacatcctgctgacacaaagctaatcagtggcttgacaactctagtcaaacatccacatagaatgtcttggccataatctatgtgtctcctgtattgtttttgttttaaaagatttgagaggaggggatgtggtggaggaatggtgcagctcgaaattgcacgtagttgccaattttcttttttctagtttgaacatatttctgctttgagcttctttcagctcaagtgagccattttcacctattatttcatctgtcttgctctgtcttcaatcttcattagccgttactatggataagctgctgtaaacgtttttaaaaatcaccctcaaggagtacaatattctattaaaaaatgacctttccaggaaactaactaatagcattagaaaattaacactattcctttaagcactaaaactgaaaaggagagaaggaggaggaggagccaggcatggtggcacacgcctgtagtcccagctacttgagaggctgagacaggaagatcacttgagcccaggagttcaaggttgcagtgagctatgatggcaccactgcactctagcatgggccacagagcaagaccccatctcttagagagagagagagagagaggagaaagaggagggagagggtgatgctagtagtagtagtgtagtaaggatggcaatgttctgaaatgtctacttttctatgtaataactgaaatttttcttggaggctgagtcattctcatgaatatcaaagattgagcctgttattcattgaagagctcttgcaatataatatttgattctgtttgccccctaaacaatgtcttactcctatacaatcagcacggccactgagttcaaaagttatgtgctgtccccattggcagacaggcatccgcaccacagactagactgcctgtcccctgccctcactgctctcgccccactggccttttctcgaggtcccggccctcacttcatcagttccattcagtatatcccccaaacagcatttccactcagcctgccaaggagaaggaaagagagtatttagaatacgtccttcactttcctgagagaacagctttaagaaaagaaaacgtcactcctactcatgttaaccacctattgccatataatagaacacattcttatgctctctgagcctgtctcttttcttcgtctcactgtttcttgacggttatgttgcaacctgaggcagagtgtcagaaagagatgagagggatggcaaaaacccattcatactttgagactccttttctctaatttttaaagctttttctctccttccattagatactgttgtttctgcgtgcttctagtatacatagtcaacaatcatgttggtgaaaactccctcagggcctttttttcttttttcttgttctttctcttttcttcctggctgggggcagtatttcagctttgggttttcgtctttgatgattgctgaaagtctgtcttctgaacaagcgaggattagttgtatccgttttgactctgactttctctttccctgttcctctacctcccacatttgcaaattactttcattgccactctgtgaaaagcagaattactcctattaatagctgggcacttgactaacattccacaggttaacccaagctttgccaaaaggaaacagcatagaaagacccagaaactctccagtgatgtggtatcagtggaataagctctgccactggagctcattcagtggctcaatgagtggcagagcttgggcagcaatgcaaagtcttcctgtgaccacatctttaatttgagtctattcgttgccgcaattttgcttttgtttttcctttctcaaaaatggcctcattttgtgaaaacaaagtgtttgcactgataattaataattactacacttttattctggtatgtatacatacttagaaagcatcacacatgcatgtgtgcacacatacacacacacagtgtgtatgtattggtagcttaggcctgggtcagtagctcagaaacatcagaatgcatttgaaggctttagcctttccttcatgattagaagatagctgtagctgctcaaataccaagtgctgtcaccatctccagagcaggaaggatggggcagaagcaatacattttgtgaggctctgcttattttattccgaagtcctttctgggagacttcttaagtgccattgaacacaacggtgtctcgggtcaatttttagttgcaagaaaggctgggaaataatgatccagcaaaggcgaatggaatcctcatggagaccaggtataactcattcctggacttgcagaaggccctaggtgcaaaggatctccatccaccatctgaacatcaggattccgcctgggtggagatggctgtgagggagctaacaagcggaacagcatctcccacaacatgttttaaaacattcacaacactgaccctcaagtttgtgcttccaattgctagtgacctcagtgtcaaaaatgtgctgacaactgtgatgaagagacaaggagagaaaaacagaccctcaggagaaacagtgggagggggaggggagtggttattaacgtgaagtttaaaatattcaaagataggaaacgagaagcttaacgtgattgtctacagtggtgtaaagaagatttatatgtgtgtgttcttcttttcaaaaggcagatttaggtaccttttggagcacaattggaatatgcaaattgctgaccacaattgctataatgtattacattctatgcatgcaaaaaagaataccagggtttgttctctcctcttttaaacacccagatttaatctgacctacaaaacaaatagggctaaaacactgggcacgtttatcaagtcttcaaaagaatggaatagaggctaatgaacaaaatgctcacatcccttaagataactcaaagattcttgctatagcacatttggggcctcttttttttcttttttataagtcaaatgatatgcaagtaacaatatttttgagtgccagatggagaagacatctgtagagtaagaaactaaagaaaacacacttccaagattaaggcacattagaagaaaattgttggctatgtgagtaatgaggagtttggaaagggttttctctatgtacaacatgctcacttactgggtgacacaaatggaagatgccaatttgtttttttggttttttttttgaaaacagttttctttactaaaaaggggctttgcagtcaaacaaaagcacactactttgctttctttcctcatcttttctgcattcctcagtgacattctgattgtttccatgaaggtgtggcagttttgtcaatctcccaatatatgcttagcctttcaaagaacctatctttgttccttgtgtctatggtgaccgtctgttagtgacgaacagatcaaggtcaagtaagaaagagaagaaataattcggcccatacctctaacccttccaaagggcgtagcttagtagtttagtagtttcgcttcaaacactgaggacagggtgattgctgagatgctgtggcagtggtttcgggctgagcaaaacacgcatagcatgctgaccagagacagcagcagctgtgaggctcatctgtttcccaacacattttctagactgtgaagtccccttggaggaggactgtccatgaattccaagcatggaaggaatctgaccattctttttcattttaaaaccacattacctttgtcctagccttcagctttcaaggccatttcacttggcatttttcattgatttgtggccagaaactgatgtgaaaaaggagaacttaaaacctgttattagtcagggtttggaatcaattatgcttcaagagtcattttctataaccaagatttcattcgcagaagacatacacttagaacaatggcttgatcatggattgggtgggggtggaggacaagaatgaaagaggactgagatggctgaaggagcctctatggaagacacagagcatacacgagacttgtatgtagcaagcgttaagaagagtccacaatgttcgataatttttattttgttttaatatgtgttctatctacttttcattttttatttttattcttttgagatgtaatctcactctgtcacccaggctggagtgcagtggtgagatcttgactcactgcaacctccgtctcccaggttcaagcaattctcctgcctccgcctcccaaatagctgggattataggcgtgtactaccatgcccggctaagttttgtatttttagtagagacggggtttcaccatgttggccaggctggcctcgatctcctgacctcaggtgatccgcccgcctcggcctcccaaagtgctggggttacaggcgtgagccaccgcgcccggccagtccttcttaaactcttattcacacccagcccaactacagcaaatcaattcctccagttttcattatcttactctttttttatattaatacctagcatatcaaaaattacagatggcaacattaatgagtactgtataatatttcttgaaaaaaatagttaattataaagctttcttagaaataaaaggaaaagactttcaagcatagagtccaggcaggtatctatcattctgctttcttccttcatggaatcaacatttttagttcccatgtatgagtggaacatgcaatatttgtttttctttgtctggattatttcactttacacaatgatctcccattccattcatgttgctgcagatgacagcctttcgttatttttttattgccaaattgtattccattgtgtatatataccacatttctttatctattggtccattgatgagcatttaggttaattccatatcttggctacagtgctgcagtaaacatggaggcgcaagtatctctttgatatactgattcattttcctttggatcagtacccggtggtaggattgctggatggtatggtagttcggtttttagttttttgagaaatctccatactgttttccatagtggctatactaacttacattcccaccaacaatatataagttcccttttcttagaggctgggaagggtttttggaggaagataaagagagcttggtcaataggtgaaaacatcagttagaaaaaataagttctaatgttcgttagcagaatagggtgaccatagttaacagaaagttgttgtatatttcagaatagctagtagacaggatttgaaatgttcccaacacagaaatgataaatacttgagctgatgaatactctaaatacccagacttgatccttacacattctatgcatgtgacaaaatatcacatatcccccattaatatgtacaaacacttgcatcaactttttaaaagtccagacaagaaaaaagcccatgttgttgataatatagaagttgcagtcctctccatcacacacgtcataaaggcagcaccagaaacaagccattgcccaagataagggtacctatttactgcgtgaatttttgtttcaggtttactttattgctgctctaattagaattcttgtccctttgtttcacactcgtagcatgtatttatgtcatctcttctctgatttgaaagataccattgtttcagcttaaaacagcccctggtttgaaagttgcacgggatgcttatataaacaacaggcagcatgataattcattgcttcctcttaattcccatgttagttgaaactggaaaaaaaatgacacatgccatttttaataggtagttgagcttcctgtataaaaaaaaaacttgtaaattttgtaatgcttcttgggacatatgtcagtaatcatcacatggtttcaagcactgggaaacatcttaaaagatgctttaaaggatgagttacaaaagaagaaaagtagtcacaagattctctataatccctgtttggtcactctacattttccttctgaatgcactttttgagaaagtaaacttacttcttctcttcagtgtcatctgaaattttgatactttaaagagacctttgcagttttgaattttgaatataatattcctcaatgtatgaaaaactacattaaaaatctaactgtggatgcctatacttgaattaacaaggagtttcatctcccaaaatttcctcatgctgtggttttttttctgagctggaattgacagatactaagtttcttagtcaatcttgcaggcgctttcagaataattaagcctgagactaccagaaagaaccattaaaaattagaatcagagttggtggtatggaaagttcttttgaaagatggaaagttcttttgaaagatggaaaacattaatttaaaagagttcaagagtttaagccaaaagagccagtcaggttatggagcaaaaaaactctgcaagattaccacaactgtacttctctttgaatagattttctactgccagttatatgaaatggatataaatcctcccattccaacaactcaggaacttacttaagtgcagggtacgatagcaactgcaaacgagtctaagaaaataggctgaatgtcattaaaatcctttgaaaatgttctgtgacatctgttttccattttgctatgctgtttaattaacttcagtcttgcagaattgcagaaatcttatttgttcaaaatagtatcttgaaggaagagaagtttatttaatagagaagactgttaagtgtaatacgggcttgattaacttcatctcaagttttaaatgtttcccattggcttcatgatctatccctatatatggctcatttccataaaactaaatcaaactctggatggcggatcactcttatccagttggtactgctgtcatgtttcaaggacaccaaaaatggaagaaattacagagaatagtgacaattcagaaactattcttatttgtcttcatcgctataatatgaggtcactggctcctgagctagtgaggaaatccaagttctaaaaaacattccttccttatatttgttttttttgtgtgtgtgtgtgtgtgtgatctttttgataagaatagttgtcaaggctgggcgtggtggctcacgcctataatcccagcacttttgggaggcagaggtaggaggattgcctgaggccaaggagtttgagaccagcctgagcagcatagcaagacgtcaagaccatggctctttaaaaaaaaataaaagtagccggcatggtggctcatgcctgtagtcccagctactcgggacagtgaggtggaggatcacttgagtccaggaattcaaggctgcagtgagctatgattgtgtcactgcgctccagcctagacgacagagtacaatcctatctcaaaaacaaaaaacaaacaaaaaagaatggttggagagagagagagagaaagaggaaaataaaaagagcaattcatcctgcaaagacctagaacatgagtgcctcttctgatgaggctcagtggtcctggaaagctcctattggacaaatcttggagaataaacagaaacattttggagaggtgggagagcgaaggaaccagtcttcattgacagctgactttatttttcgatttgtcagagcacgccaaagcccagtgccctgtgaccaggacaaaaggggaagtggctgcattttgacatgtcccagcttcactagagaaagcccacttgtttctgactttccagtgcgggcaaaagctggcagatccaccacctgtgctcttgctgcccagcatctagggagctttgctattctgagtgtttctgaggaagccatatggatggtgctcaactggatttttctacttagagggctttatggattttaatgtagaggtcgtggcttctctgcatcactggcaagtgttgtccatctctccgtccttcttgagttccatacccagtgcatcatgaacaaatccatcttttttatctgacctatgctgtgtctactctctcagctcctgcttttgcttatccctcaaaggggaggtgttcttagctctctgacctctgggttgatacagaggccaaatttatcccagggaaggaataagtacatttgaaataagtcactgagaggagaagactgtgtgttttaaagccaggtttgtttaaagtgttatgatagtattaagatgttctttcattttcatagaagtacttcatttggctagaaggtcaaatgcctggtgctttgaggacctgaacagtttctgttccatgaacataccggactcaggagttcttttgctccagatactaagttattagaacagtgtttcccaactatggtgaaagaaaatcaataatcagaattttttagtagttttcagtatttcaaaagatctagttcgtttcacagttcaactgaaatgatgggtgtatttgcatctagtggcaatcatattcactatgttaaccctacatatgttaatcataagctctgattgacagttgtatattttctgtttagcactaaataaggaaagaattctagtaatttattgaatgtagttggatttccttcagactacaaagaatgccttgacaatctcactccctccttttgattttcagtgattcaggtcatctggattcctggccttcctcctgctattctcttctgtaatctccatttgcccgaccacctcctaccatcttttagtttaaacgccattctctgccttccaggagctatagactagaatagattgccttctgtgtcctccccagcagtagaaatttctactgcgtgataactctcacgcaattactctctcagggttctctgacaccagagattgtgttatatcttattctttaccttgccccagcccctgccctggtgtttggcacataatctacactcaataaatatttctttgtttaatgggtggattgaattcattgtcacactgagtgacatccatctggatgcttgattacaccacgcggctatcatattctgaaggaacatgatatctatgaagatctcaatcatggtttaatccccagcaactagcacagtgtctaagacagaaacttaatatggttcaattactttcgagattttttttttaatggggacactacagatttggataaaagacattaatgatgatgtttcctgtcctatcactaggcagttctatgaaaaggcactccttttttcaaaattccaacttataatgtaagatttgatgggtttgttcaattcctactaagtgagcagtaccatgattttaggtctgtaagtagcttaaagttaaacttagaactttggttggcgatgctcaccctggtctctgttatggataacagtttgaatgaggttgatgactgggtcttttaacttgatgtccttgtttattttctgcttgctttgtttggtcaggtctggcatggagccgaaaaataagagcttgcttgcagtttgactttcactgtgattcagttttgcaatcttttaaaaacatccttcaggagaccgccatgtatctatctgtggacatctcccagattttccaaaacaagcacaagataaataagggggatttggaaatttccaaattttaacagatgggaatttgcttccactgtctgagaaatctttgctatagatagaggggaatcccagaaaaaaatctaagtctgaaagctccacagagttctctgcctttgccttccctggaaaaggggtcgggggagagcaaacagatgctagaagccagtaaagtcctgtcctcatgaaagctctcagcccagaggacaacactctggggcagtcacttcagtcataggatatttccctctccaaataaccgaggagagagcctaacctctggggtgagtgtggtgtataaagtgtgagaatcgtgcgtgtccaggaagagagtgctgctaacagatgactccttgggggccccctttgttctctgcttctgtttgtattgagtcagcttgcttaggaatatagatcagtgagactaaagtatctctgttgggccagttctttcttctctgtaccatggtcaatctacagggtgcctgcacatcctccacagcctcgaggtcacagacttactctctgtgtctctaggctatagagcagaacaaaacagagccaagacaaggtgtctggaaaaacagaactcatggtcttccaacagggcatcaaagggtttctaaaatttaaagccaaagggaacctcaggggtcacctggtccaacccctctgttattttaggaggacaagaggcattaagtgattcagaagacacagtctagtggtggcaaagaggacaattcagacagttcccaatttacaatgattcaacttatgaagtttcaactttatgatggagtgaaagtgatacgtatttagtagaaactgtatttcaagtataaccattctgtttgtcatgttcagtacaggatttaataaattacatgagatattcaacactttattataaagtatgctttgtgttggatgagtttgtccaactgtaggctaatagaagtgttcagagcacattaaaggtaggctgagctatgatgttcggtaggttaggcgtattaaatgcattctcaacttatgatattttcaacttacgatgagtttattgggccataaccccactctaagtcaaggagcatctgtataggctttggggtcaggcatcagctggaatcctgactctacctctttagttcagctatgaccttgaataagtcacttagactctttaagctttagctttattgataaaacaaaagtaataatagcaccataggactgttaagaggattacattagagaaaattcatgtaaggcacatagcctaatgcatggcactcagtaagtacctaaaaattagtagcaactattcatcttcgtcatcattatcatgatcatcaaagctggagcctaggacccaagcctcctagctcagcattcctcttacaacagccctttgaatcaccttcatatgtcgttaatacttcattgggtaccccaatctatattagtttaagtacagactgtggtgacatcattagttagagtctgtgagatgggaggggggggcaaataatgattcattctcttaaaaaggggatgtaacacttttttttttccttcttcaactggaatagttagggatgtaacactttaaaagagcatgttgtacatcaaggtaatataggtaacttaaatttattttggattttgtttatgtatggttgcaatcccattagagtttaatggtattttcattttacaacacattctagtgtgttaggaagtatgtgttaagagttctcttctatttattattttcattactttcccattccagtatagacatagtaaactcctaaaattaagtatattcttcttaaagaattctaagtgaccattttggtggaaaaactacctgcgctagtttgcatgtgatctaaatgatccaaactaatgggtgagctttgggtgcttgaggactatatgcaggagaaaagaggagggatggataaaacttttccaattttaaaataaaaattattttctgaatgtgctttaaatgcatctgctacatgtactcaagaatgttgagtctgacccctcaaatttattcattaagttttgctacatcagactacacaaaggtcgggaaatcatgtgtccaaaataaaatcagatttgagctccaccttattctggcctatacaatgtccctgttcttaccaccttttctcgtctttcacaaccttgaatcagaatctctagttcaacatcatttccttttttccctcccccacttaaacataaaatatagatatgtgaattctataaagcctgcttggataatcagcttaccctaattcagctcttttcctcatcaagaggagggacttgacagctactcaggaggctgaggcaggagaatggcgtgaacccgggaggcggagctggcactgagctgagattgcgccactgcactccagcctgggcgacagagcgagaacccgtctcaaaaaaaaaaaaaaaaaaaaaaaaaaaaaagaggagggacttcaaaccttagtgctggtagtaacacctgagacagaaaacccgtgtgacacagaatatgagtccttaagcaaaaggactgtcgtattcatccctgtgtctctggagctagcacagtccttagtgcattgtacatttgaacaaatgtttgagtgaataacaagcccgttctccattctggttaacttacgagtactgtaccaattttcttccctgggcggaaaaaattatgaaccatggttcttgtgaaagttattatttttaaatgcctagacattcattcccagaactagaaacataagaaacaagttgatacatcaagggaccaagagatataaatgataataacttggaaatatttaaagttgtaaagatcctgcttagaagagggaagttatcaaaaggggttgagacaatagttgaatgactgagaagacattaatgaaaatcacataggagtatgatctaagaaaaggtacttgacatttttccaagtgagaaaactgcatgatcagataaccatgcataggttggagatgtgtccagagaaatttattcctgaaagacagcgataaagtaccagagctaaaatagtccatctgatagagacattggagctgagatctgaaatgatgcctgtttcttattaagttggattctatttactacacattttttagtgtatagatagaaaagggtacacaataggtacctaaaagcagatagctgtaattactactatttatcttttgtgctctgaggtttctcatactgtgttggtgccacactctaatcagctgcataaaagggtagatcacttgccaccacagaggcatgtgggagaagacagcatgtctaggacattacgctgaggctgaggcagtaggcaaggaagtccaacctgcaggctaagagtcagttttcactcctgtgggaaaagcatgcccagctctcagcaaaagcatagaaatcaagagagaacagtaaaggcaaacaggatatgtagcctagttccagttgaaggtattattcctaacaatgaaaaatgtcaatataactatttccagagttaaaacttcagacacatgctatgacaatgagacagtatgtttgaaactacagatgtccaaggaaattcaggctatatgctcaccatatgtagagaaggcagggaaatttaattgtttgtagagaaagagacccaagacttcgtaaagccatgggatatggagttgggggacctgccagtcaccttgtcagttcacttcattttataaagaaaatttctagtctcagggaagccaagcaactttcccaaccaaaacgttagctttgcgttaagagaattttagagatagattattaacatcttgcggctgagatactgtaaatatcttcaagaattccaacattttgagcaattgtaactcccagaataattatttttgctataaatattttgcccattttatggtagtattccagggtctttactcccaagtcaaactcaaatattgggaaaagtcggatcctttttcttatcaattcccacttcacattccccgttgtgatcagctttctgaatttatttgtaattatttcttcagaagagagaaatatggataatggacggaggaacaggagaaaatgttagcatattgacacaaaggtttcagtattctaaataatcaaatatttgaaaaatatatattttgtccttttgccctagagatataaattgacacaaaaatatttacaaaacacattagtagacatcaatgggtctaaaactgtggtcctccaaaccagcaacatcagcatcagctaggaatttgtggaaaatgcaaattttcagtctcaccccaaatcagttgaaccagaaactctggggtgggacctggcaatctgtatgtatttaaacaagtccaccaggtgtttctaaccactggtacagacaaatcagacaagcataaccagattattggatgtcagttctaagtaatatagggggtgaatatatcaaatcctttgggagaataaaagcttagttgacttctatggtgtattcgtttcctattctgtataacagattaccatgaatttagtggcttaaaacaccccacatttaataagcttcgtaagttcctgtggatcaggaatccaagcataggttagctgggtcctctgctttgagtctcacaaggctgcaatcaaggtgtcactcaggctgtattttcatctggaggctcaactggggaagaatgggcttccaagctcctttaggttattagcagagtgcatttccttgtggttatatgaccgggccttggtctcttattggccatttaatggaggctgccctcagttcctagaggccactccagttatctgccatgtggccctctccagaggcagttcacagtgtggcaatttgctgcttcttcaaggctttcaaggccagcaggagtctctctctagtctgctaagatggtgtcatatatgtcatataacataatcatgggagtgaccttccatcacctttaccctgtgacagagtttagatatatgtccctgccaaatctcatgttgaaatgtaatccccagtgttggaggtggggcctggtgagaggtgcttggggcaggagggcagatcccttatggcttagtgctgtcctggcaatagtcagtgagttctcgttaaaagtgtgtggcacttccctgccactctctctctcttgctcctgctctcaccatgtgacctgcctgctcctgcttcaccttccaccttgagtaaaagcttcctgaggtctcctcagaagctgagcagatgctggtgccatgcctgtacatcctgcagaaacatgagatgaataaacctgttttctttataaattacccagtctcaggtagtcctttatagaaacacaagaacggcctaacacactacataatgtaactaattgagtgagtgacttcctatcacctttaaaaaaaaaaaaaaaattggtcaagagcagtggctcacgcctgtaatctcaacactttgggaggccgaggcagttggatcacctaaggccagaagttcgagactagcctggccaacatggcaaaaccccatctctactaaaactgcaaaaattagctgggcatcatgggcacctgtaatcccagatactcagaaggctaaggcaggagaatcacttgaacccgagaggcagaggttgcagtgagccgagatcatgccatttcactccagcctgggcaacaagactgaaactccatctcaataacagtaataatgataatttcaacctttattttaggttcaggaggtacacgtgcagatttgttacatgggggtattgtatgatgctgaggtttggggtacaaatgattctgtcacccaggtagtaagcatagtaccccaataggtagtttttcagcccctccctccctcccctctcctctcatagaccccagcatctgttgttgtcatttttatgtccatgtgtacccagtgcttagtttccacttttttttttttcaagttggagtctcgctctgtcacccaggctggagtgcagtggcaatatctctgctcactgcaacttccaccttcgaggttcaagcaattctccctgcctcaacctcctgagtagctgggattacaggcacctgccaccacacccagctaatttctgtatttttgtagagacggcgtttcaccatgttggccaggctggtctcaaactcctgacctcaagtgattcacccacctcaccctcccaaagtgctgggattacaggcgtgaaccaatgcgcctggccagtttccacttataagcgagaacatgtggtacttagttttctgtgcctgtattaatttgcttaggataatggcctccagccacatccatgttgctgcaaaggataaaattttgttcttttttatggctgcatagtatctcatggtgtgtatgtaccacattttcctatcacctttatattctgctggttaaaaacaagtcacaggttctgtctacactgaaggccaggggattctacaaaggtttgacttgtggtttaggatatgttcaccatgttgcagaaattatatatatattttttaacaaaattggccactatttagtatgcttttttctttgtacatgaagcacttttgaaaaaaagtcactgactacagtcttagttaccaagttgaaatcaaagatagatttttcttccaactgcaagaaaaattcagtgagtttagaagaaaaaagttattctactcagctgggtttgacagaaacactatttctgtggcctcctgtccccatcccctagttatgccttaaggcccttctcaaatatcttctccagaaagactttcctaatacttctaactggaattgttctccattttagtgcccatttattattgtacttccggtttactttaccattatttggatagatgatttgtctctctgtctggttggtaactgaaggtaacagaaactcagcaaacagatgttacattcatgagatcacatattttatatatgtgtgtgtgtgtgtgtgtgtctgcgtgtgtatttttttttttttgagatggagttttgctattgttgcccaggctggagtgtaatggcacaatcttggctcaccgtaacctccacttcccaggttcaagcgattctcctgcctcagcctcccgagtagctgggattataggcatgtgccaccatgcctggctaattttgtatttttagtagagacagggtttctccatgttggtcaggctggtctcaaacgcccaacctcaggtgatctgcccacctcagcctcccaaagtgctgggattacaggtgtaagccaccgtgcccagtccacatattatatttttgaagcctctccggcagtataatatatgctaacataaggtttgatgaattataaaagcaattaattttaggtattgggacacactaaaatctatccagtgtagatttccacactgggagagcaatagcctgtcatagcagctttgcaatcagatagccctgagatccatgcctgacatctccaattaatggctgtgtgacctggagcaagaaacttaatgtcgctaaatctcactttccttaatagagtcattactgaataaatatcaagctattcttaatatcaacttggaagtattaacatttcttaacacagttcacaccagggcacggactccacagtttaacctcatctccaggaggttagcatgcacacgtatcatgttcattcggtaggacagtaacctgctagcaaatgtagactaaataaacactggatcattcctgtagttatttataaatagtctccatctttggttgtgattttagtggttagaatactagaaaaagagtgggtagagggacaggacataaggaattccatgttaatcagtagcatgggaaggctggtcattttcacaaaaccaagggagatgaaataagattgtcctaaacactgttctgagaattacacagaacatgaaaggctgcttggagtgagtcagagctgggatgttataacagatccgggctctgtcgaacactcagtcccccttgccaaatgtaggaattcacaagatcaggctcaaacttaaaagtcaatttcttgtaggctgggtgctcacggctgtaatcccagcacttcgggaggccgaggcgggtggattgcttgagcacaggaattcaagaccagcctgagcaacatggtgcaactctgtctctacaaaaaagtccaaaaattagctgggcttggcggcatgcgcctgtagtcccagctactcaggaggctgaggtgggaggatcacttgagcccaggaggctgaggttgcagtgagcagagatcacgccactgcagtccagcctgagggagaccccgcctaaaaaacaaaacaaaccaaaaagtctatttcttaaataccatgctagagttatgttcattccttgcagtcatctaatcagttcccataactttcttgataaaaggcagatgttgcttttccatagaatagagatggttatcttggccaaggtgtttatgcaggagtgcgggtactaagatgattctagatttgtacctttttaaaagtctgttgtacagttctgtgttctgagattaggtggcattgtgtttcctttttacgttttttattctgtttccacagagaacatttacacactttcaaatgatcctgataactattccatacatatgatatcattggcatctatatactttgaaaatatggtagtaatttttttttgccatttatatctactggtgacccccataacttgaagctactttttagtgaccacaaaacttacttaaattcccaatgtatattattattatttccagtacctaaaatcttttaaaacttatagtataaataattacaaaataactttgaggagaaatttagagagtgaaaagagtaagagagaagagaaacaagaggaggagaagaaagaggaggcagcctagacttgtgaccaaagcttttacatggggtgaaaaaaagctaaactatattaagagtacatttatgagacaatggcaaagcgaacaagcaagagaaaggattttgacatatctcagttgacattatgaaaactctcattgcttatccttggaggaaatatagcaaccacctgactactcacaagcagcaaatgctagagaagactctcccctcttaatatcaataaactaatccccaccttacatgccatttaagtacaaggagaaagtagggaggtatataggcttttagttcttttaacatttgagaacccattttggccccaagtttagatacctcaacatttctgtcactaaccttcttccctccctccttcccctgcttcctgaccccccaaacccacccctttgtctctctctctcccccgaccctctcctcctcttcccttgcttctgagttgggagggatttgagaagaatgaacccataccaactccgccctagccagcattcaagatggccccatgaatcttgtctcctggtattcatgctttttctgtagtctcctcccatatggactcagagttggtctgtgtaactcacagggtgtagtgggggtgacagtgtgtcacttccaaggctgggttaaaaaaatgcacagtggcttcctacgtgcaccctctctgtcaacttccattttgataggatgctcactcatcacgtgtagaggcccatgcagataggaactggggcctcccagtgacgaccagcaccaacttgccagccgtgtgaccgaaccaccttggcaatggatccttcagccatagtcaggcctttagctgactgcggccttggtcaacatcctgactgcaaactcacgagagacacagagccagaccccccagctagaccactgccaaattcttgcctcagagaaaccataagagacagttaatgcttattgttgttctaagccaataaattttgaggtaataggttatgcaacaagtacatactatgtaataggtatgcaatagtatacaataatacaaatactttaaaagaaaagtcagaaatctaaggataacaaattcagagctttttaaaataagaatgttatctcccttgagtatttagagcctctagtaattgtccttgtagaatttgaagaaggttgcaaactttccttctttgttatttagagaaaatgtgtaacaaaacctataagaaatcactgctaatctatacctcaggagcctcatctcctgataactttttttggcaaaatatcagtgctcttccattgtgtgtgttcaaagttttagtcatccttacttagttaagatgattatatatgagtataccttttagttaacttccttttgatacatggtttatttcatgcctagggtaatgattgatgtttattcaaatgagctgatgtggatgcaagttcctcagtgctatacagtaaaattgctgttgacatcttccagaacaaaactgagataagatcctaattgtggattcccaaatattacttttcaaatactgttacattatgctgactattattttccattctggtgcttcttaagctcattacatggtgatgatttgtatatgggaacagtctgaagaaaaacaattgtgtgattttagataaaaacaggattcaaccgagatatggagtatctcaaagtaaaatgtgctattcccatctttctattctgtgtttggctccaagtccttaaacattcattcaatacacactatacagatgttcaaagaatgcctagtgtgcattgcttagtgctcaactgtgctaagcattattccacacatggggatggaacaatgaacaagacaaacaaaggttctgccctcatgaagtttacattttagtctgggagacagttaataggaaaacaagtataaaacaatataatgtgggatattgttaagtactaaaaagaaaagggtggccgggcgcagtggctcacgtctgtaatcccagcacttcgggaggctgaggtgggcggatcatgaggtcaggagatcgagaccatcctggctaacacggtgaaaccccgtctctactaaaaatacaaaaaaattagccaggcgtggtggcgggcgcctgtagtctcagctacttgggaggctgaggcaggagaatggcatgagcctgggaggcggagcttgcggtgagccgagattgcaccactgcactccagcctgggcgagagagcaagactccgtctcaaaaaaaaaaaaaaaaaaagggcagggtagagggatagacaatggctgcaaagttgagggatctaatttagatggaggatcaggggagtaaaatatgggcagggacttgaattatatagaaagagcaaaccatgcagaaatctgggggaagaacatttctaacggggaaagatcacgtttttaagccgtgagtgaacagaagcttggcatgtgggagcttaagagtaagagatgagagaggctgtcagagtacatagggcatgatggggaagggggatacagtagaagatgagattggagaaataaacaggaaacttgcaagcccgggtaaggacttcggtgtctattcaatgcatgatgagaagccacaagaaaattccaagcaaggaagttatgtgatctaatttaattttttaaatagcacactttgcagctgcatgaagaatagtctggaggtagcgagaaagccagcaagaccccttgaagggttactgtagttcaggccagaaaccatggtggcttgtggggtggaagtagttagtggaggcaataagaagtgatgggagctgcatctgctgcaagaatgaaggctgttctcagtaatcagactgtccacattccagaaaatgtcgacatcactctgaaggggcacagttcttgtgaaaggccctagaggaccctgcagagggacttcagtcacgtcagtatagaactcgggctccttggaaagaaaaagcagaggctccagattgacaaatgctgagaagatgggaattggctgccatgcgtgctatctgtagtcatgcacagaagatgatcaagggcgttatactgggcttctgtgacaagatgaggtctctgtgttctcacttccccatcaatgtcattatgcaggagaatagctctattgtagaagtcagaactttcttgagcgaaaaatatatctgcagggttcgggtgagcccaggtgttgcttgttcaatatcccaagcccagaaagatgagttcatccttaaaggaaatgacattgaacttgtttcaaattcagctgctttgactcagcaaaccacaacagctaaaaaccaggatatcagaacattttggatggtatctatgtctctgaaaaagggacagttcagcaggctgatgagtaaaatctaagagttgtacagctacagaaacaagatgtcagataattcctaagacctatttgtgatattttaataatgcaataaaagacagctattgaaaaataaagtagtgatgaggtttcaagacatgaatgatgggatttgctgatggctagcactcaggatgtaagggaaagagaaggattgaggctaactattgagttttggtctaagaactgcatgaaaggtggtatttatggacgtggtgaagagtaagggagagcaatttgggaggtggaagagaaccgagagatctgtggccaggttaagtttgaggtgtgtttatacatttccatatgggaatgtcaagtaggcagctcgaaatacaaatcgcaaagatgttggactcaagctataaacttgagagtcaccacaggagaaattgtgtttaaggccatgagactatttgctgtctcttaaggcagtgaatgtaaatagagagaagttctaagaaccggccttgaagcactctagcattagaggccgaaggtgaaaaggggtacccagtaagatggaaagcccagaagagtttccagatgaggacgatgtttcaggaagaaaagaaatgagtgatccattttatccatgctacagagtgtccaaaacaaatgaggaccgagaataatcttttgaattggacaagacgaggtcctggttgacattccaggaaggggcggagacagagcctgagtgaagtgtgttgaaagaatgaaaggtaggaaagtagacaccatgaaatacaaacagatgtttcaaggaattagctgtgaggacaaacagaaaactgatacagtacccagctggaaatgttgatttcctcagatttcttatctacaaggtgaaaaattttagataacttctaaatcccaatgtattacattgccaagtcaaaaaaacatcctagggtgagtgcctgaaaggctaaattgtgaaaaagagtcattactcgggttgttgatgtcctaaatatgatggtgtcattactgactagggagggtgctagcatcatttgtatccaatgcccatgtaatgatttgagatgacaatggaaacgttaagaaataatttaaatctattatgagaacaactctcatttattagtttacttgtagccatttctgtgattcaaatgagcattatgattattttctgacagaaagaacgaaatctcaggacagttccatgtccatctgtaattagacctcatggccagagggccacaacagtgaggtatgtgacacatcacctctgggctgctgtagctgggcggcatgatgactaagtgaaaatgacaacggcaatagtaacaggtgtcactataccactttagaatttacaaagccttttcataaaaattaacatatttaggctgggtggggtggctcacgcctataatcccagcactttgggaggccgaggtgggaggatcacccgaggtcaggagttcgagaccagcctgaccaacatggcgaaacctgtctctgctaaaaatacaaaaattagctgggtgtggtggcgcatgcctgtgatcccagctatctgggaggctgaggcaggagagtcgcctgaacctgggagctggaggttgcagcaagctgagatcacgcaactacactccagcctgggcgacagagcgagactccatctcaaaaaataataataacatatttaatcatagggaccatttaaaatgctctttcatttgtattaaattagttctccaactctgacagtttgagcatggttggcccagctatcctgatggctccttcctgctattttttttttaatgtttaaaactcatcttttcaagctcaagagctgttgctttgaagaggatttgaataagcatctgaaactgttggctcagacattgatccaactcaaatttccaaagctgctaccagaatgcttttcccatacagatccaaaatgaatgtgaaatgctgcctgtcctctttctcctgtcttcctttcagtgactccactttctccacagtggccctccacgtcaggcagcccttctaaagaatccactgcttgggtgtgtgtgttccccacgttgcattcagaaggcacatccatgcatctcaggcgtgtaggttcttcagcatgaatcatgcaaacttggtgaaccataaacctctccctgtggatatgagtttgttggtattttagtctgcttggaaacagtctgagaaacattaaacccagcttttttgaggttagtccaaattatttttttagactagagaaaaaaaaatattatgtctcctaaggaaacttgtaaccacgaacagtaaattttaaatgttttagaatggttttctttttccccctcccacatcccccacttgtgcatagttgaaatccctagtttctctcaccaagaaatactacatgctagactcacagatccatgggctgggcctgtgcaaatggatttcttagattaaaagtataaaaacaaggctgggcatggtggctcatgcctgtaatcccagcactttgggaggccaaggcggatggatcacctgaggtcaggagttcaagaccagcctggccaacatggtgaaaccccgtctctactaaaaatacaaaaaaaaattagccaggcgtgatagcaggtacctgtaatcccagctactcaggaggctgaggcaggaggatcacttgaacccgggaggcggaggttgcagtgagccgagatcgtgccattgcactccagcctgggtgacaagagtgagactccatctcaaaaaaaaaaaaaaaaaaaaaaaatatatatatatatatatatatatatatatatatatatatatagaaacaatatatgctccattatactgaccccaccaatcttaccctttctccacttttccagttcaatcatcccctaagtattcgtgtatagtaggattttaaaatgcacagtaccattcatgtgcagaaaagcacctttatttataaaatatgaattcaacttgctctacttggcaggaaggtacctagacctcactcacctattcaaggaaactgagtcacttcctgtttcaaaccacagtttttccaggttaactcaatctctgtagcatttaccatatccagcctcaaaggaccccacccatccatcctttctttgttcctttggggaaagaggaacctgtgagaagaagaaaaccacagggaaataagactttgagtttggagaagaataagagagcattataaagtgataaaacctaaacatggttcattaggaaaaagtgactgaaattctaatcctgtgcaggtccaggattatgagggaagcaaaaagaatgccactgacactagaatagagtatttcctgctgggcatggtggctaatgcctgtaatcccagcactttgggaggtggaggcagtggatcgcttgaacccaggagttcgagatcagcctggccaacatggtgaaaccccatctttactaaaaatacaaaaattagccaggggtggtggctcacgcctgtaatcccagctgctggggaggctgaagcatgagaattgctggaacccagggggcagaggttgcagtgagctgagatggcaccactgcactccagcctgggcgacagagactgtctcaaaaaaaaaaaaaaaatttatgtgctgtcacaactgcaaggcatgaggcctctctccctccctggcgtttccacatggcacttccccttgtgtttgacgtgtcagcctctgtcctcattgcaaatctcctctgccttccagcctcagtctctgtacagactctgccctcctcatcttggctgcagggttgtcaggttctttggccttctcatctcacagccacaggagcgtttgtgaacttgtgatcctccctagttcccggctctggcagtgggtgcggggaggcctcaacacagccagccccttggttactctactgtgactacctccttttggctccgggctcggtgacctacttccaaataccaaattgcagcatgggacttttctgattttcatttgccccctcaaatctatgaggtttctatgatctctttcatctcttctctttctcgtgagttacaagggagtaggggcgtaccgggtgcctcagaaggaacccaagtagcaatttcaccatagtctcatccctccaaatttctcctaaaaaatattccctcaatccaggatttttactacttccctctgtggagagaaaccccatgtctaacatctgtctcacccaagagcatgctggaaaattctttggcttcaaagtccaaagattgattctggatattgaatgtccagctaagggaaaccaagaaaagacttttctgttttctccttcaggtacctggtccttgaaattgaaacctagacacttatgcctattgtttttcttgtaactttcaaaatctattttgatgtcaaaatggaacaatggtttttttgttatccatcgagttctgcccttctcaagaagtatggatggctcaacctcagcagatggaaagctacagggaaataggaagtaccatctcaaggaaaagaaatgtgcctcattagaaatgtccgatgcattttttgttctcagtcgttcttgcaacccaaggactgagttgcaagtcaaagtgtttatcaatgttaagtttgaaccaaagacaaaaatctctgttgttctttccttcttagtagttcttaaactacttatatattagaacgctgctgtggaggaagaaatatttttagtttttcatacggaaaagttttaagacacacatttccatggagtatatttttcccacagtgttttccaaagcctctgtctttggctcagcatttctccaactggaagtttcaccaatgagtcccctgtgttcctgtggtccgctgtagggctactctggagtctctggcttattagcatgtaaaactcggagattctttccctccagttaaagtcatatccacaggatttacatgaaatatattatatatggcacctttctttgtaaggtagctagaaagtggctttgggaattttttttctgagacgagtctctctccgtcacccaggctggagtgccatggtgcagtctcagctcactacaacctccgcctcccgggctcaagcgattctcctgcctcagcctcctgagtagtggggactacacgcacacaccaccacgcccagctatttttgttgttgttgtttgtttttttttttttttttttttttttttttttgtagttttttgttttggtagagacggggtttcaccatgtttccgcggctgatctcaaactcctgggctcaagtgatccactgcctccgcctcccaaagtgctgggattacaggcgtgagccaccgtgcccggcaggaaatattctattctagtgtcagtggcattctttttgcttccctcataatcctggacctgcacaggattagaatttcagtcattctttcctaatgaaccatgtttaagttttatcactttgtaatgctctcttattcttctccaaactcagtcttatttccctgtggttttcatttataagggaagaaaagaaaggacgacaagtctatttttagggatccattaaaaattcattttttaatagtccataaacattgcgaagtaacttgggactcatacatacaattctgattattttaaattgcttcatgtgataattgcaagcatttattgagcatttacacattactgaacttaaaacacataaaaatgccattctcggctgggcgcagtggctcacacttgtaatctcagcactttgggagccaatccaggcaaatggcttgagtccaggagtttgagaccagcctggccatcataatggaaccccatctctattaaaaatacaaaaatgagccaggtatggtggcatgtgcctgtcatcccagctcctggggaggctgaggtaggaggattgcctgagcctgggaggttgaggttacagtgagccaagattgtgcctgtgcacttcagcctgggcgactggagtgagaccctatcccaaaaaaaaagaaaaagccattctctggcgatcattaaaaagtcaggaaacaacagatgctggagaggatgtggagaaataggaatgcttttacactgttggtgggattgtaaattagttcaaccattgtggaagacagtgtggtgatccctcaaggatctagaaccagaaataccatttgacccagcgatcccattactgggtatatgctcattggattataaatcattttactataaagacacacgcacacgtatgtttattgcagcactgttcacaatagcaaagacttggaaccaacccaaatgcccatcaatgatagactacataaagaaaatgtggcacatatacatgatggaatactatgcagccataagaaaggatgaattcatgtcctttgcagggatatggatgaagctggaaaccattattctcagcaaactaacacaggaacagaaaaccaaacaccacatgttctcactcataagtgggagttgaacaatgagaacacatggacacagggaggggaacatcacacactggggcctgttggggtagggggcaaagggagggaagcattaggagaaatacctaatgtagataacaggttgatgggtgcagcaaaccaccatggcacatgtatacctatgtaacaaacgtggacattctgcacgtgtatcccagaaggtaaagtataactttaaaaatgccattctctacagaatttgataaatttttaatctcagagcttgaaatcagttacaacactgttttaatctatgaaattatttcagtgtctttctatgaaatttagacccaatcttcagataccatagagtacctactatgtgccgggtgctctaattagaatcttccatttcattgtcatttaattctcacaagaaccctgctaagcaggtggcattatctcctttccacctgtgaggaaacaggttcacagccgttccacagccccaagcctcacatggagtaagaggttgagtaagatctgaagacacatggcacttttaggccacacagtgtccaaggtatttaaatgaagtagatgactgagtgttttttaagccacacacttacagaaaagacactaggagatgagcagaaggtgtttccctggagatgctgccctggtaccacagcagcaggaggtgggacaagctgacttctactctgagtgagttaagaacctcagggctgctctgggatagagacagcatgaacaccagtgcatggagccattgtaccctggccatggtttttgttttagatcagcatcaggttcagaaatccagaaccaaaaagaaatgaatgcaactcccattccatcaggtcaggagtgaccaggcctcccacagacctttgcctgtttcctccccaagcgagcctcagagccttagaagccctctcccacatggtcttgtattaaatcatgttcttctaggtcaaataacaagggtccgttattcatgcctctgtttatttattcatatgtgtattcattttattcacctataaatatttactgcagtaatattaaccagcgtccttgtggatatcagagtgccacggatataaatatgggaagaaaaagaaaccactttaaagaaaaaaattcttttagagagtatacttactatatgtcttcttatagatatgggactttgtcaatggtgagtgctcagtaaatattcagagacgaataaaatgaataaacgtatgaatgaacagaggagtgaataatggacccttgttacttgacctgagagaacataatttaatacaggaccaatttctatcattttcctataagtaatgtatttctatattacatatgatattttgatataaattatattttataagtaaatcacctctaggctggaaaactcaccctatgttggcccctaggaacatttaaaaaaatttttttagaaacaggatctttctatgttgtccaggctggagcacaatagctattcacaggtgcagtcatagcacactacggcctcaaattcctgggctcaagagattctcttacctcaacctccagagtagctccgactacagatgtgtgccactgtgcccaacttttagagattttttttttctggctcagaaaaaatccctctcagtatgtttattccaaaccctttctaacaggtgtccatgcgttaggcaaaaagccttacagcttctcagattcttctcagattcaaagattcatctgtattcatcatttgagattcatctcaaagacttgcttagagatgaccgtaccatctctaagcaagttttcctttctctctaacctgctcctttggttcccgcacctctcttggctccaggtgtcaataaacaacacctttgtcagctctttccattgcctcctcctggtcagagcatgctgagtgagcttcacttaaagcctcacttttgcatcggataactttttctcatttgaatcgagggtttatacactgcccaatataccatatccaatataaacaggaaagaacatgatttctttgtagtaggtagcctcccttctaggtcttcttttacagtgtgatggttatcaggcttaggaatcagaaaaagttagtctgaatctaatctctagtccttagctttaacctgggcaagttattgccatcatctgaaaaatgaagataaaaagaatgatgaacaaatgagatcacatatgcaaaacatacagcacaatatttgaaaatagagaaggtttagtaaatggaagcgatgatgctgaaggagggagaaggaaaaacagagtagaagaagaagaggagaaaattgctaaataatgagtagccatcttgagagacagagagcgtggcccagaggacatgagagattaggaactgctgcgttttatagggaaagggaacacaagggtaggaatgtactggaaattccatccaaagaggactcaaggtaatgcaagtcagaatgggtacttgggagcatgggatgacctcagagccaaggtgatattacatcccactgtcacccacttcacactgtggtcttaatttagctacacgttcatggacaagaagttcagagccagctcacactgcagaactgggttccggttttataagctaacttactgtttgccacagattgtaacctctttcccaaagaacagacataccaggagccagaaagtagcttttaattaatgaatttgtcatctgctgctcagtggtaatgagggaaatcctgtgccatacattcttttaagtgtagattcaggatctggatatgtactagtgaggtcagcaattcagccctttacctctgattgtgggccaaataaatggctgaattactcatgggggtgtggattttgttaagtgtggtgggtaggggttgggaggaagagaagagggtgtgtctttcttggcataggccaaaatgaatgaaaatgctttgaatgttattataatctattctgtgaccatgtccaggtggctttctgccatggctctgggcacacccatatggacttagtccctttctgtagggatttcacagtttctggttggcagagtaaggacccaagcaggaagattttcttccccacccaacacacccctgaatcctgccaaatgtgaggtgtgggagtgataatatcaacgcaataataccaatagtaaccacaataggttcttaagaaactggaaaagggtactgagaagttttttccaccttttttgtatgcctagtttgctacattgctcctaagttcctagacttctgggcagctctgcctatggaatagccattcttttactcctttactttcttaataaacttgctttcacttaaaaaataataagttcctagacttctctttagtgaatactagagctctacctgaaagaacccacattttcaggtcaattcccaaaactcaaatggtagtgtcatggacttgaaagcagtcttagggactgtccattccaacattctgcccatcacagacattccctgggagcacccaaggcaggcggttgtccagcctgtgaatggacacatgcagagacggagagcctgtttcctgagaaggccaagccatgatgggcatctgtagtggctgcaagacagcataatgcgggggaaagagtataggattgggaggcatgggaattggttcagtgcttgttcttccactgaccagctgaacgaccttcgggagaagtcactgcgccttagaatgagtcacttatcaactatgaagctgttggatatgatctcagtcattctagcaataacatggtcatttaaagttgtttttctacgtctagccaaaactggcctcctgtaactgccagctattggtgttagttctaattttgagaaatgtagaggatgggtcttatctcattggtgtggcagctcatcaagtatttaaagatggctgcaatgaccctgtaagttatctcttctttagtataaacatctcaagatactgtaaatcttccttttatgacttggctttcagaaatcttcctcctcctgacagtcctcttccagacagactcaactctttaaattatggtccctagaattggatgcaacatttcacaaccggccaaataagagcccaggaagtactgggactgtaacaacccaaccctccacaactatctctgcctttcatctagaccctgtgctgcttttcacttaagtttgcctttgcgttagttatttcagcctccatcgtcatctcatgccacagactgtgcctgtggttgggtacagccaccaggcccttacacatgacctgctctccagccacttctcccctgttctggacaaacacatagaatgatttcccccttttcactatacaattaatatatatgcatagtaatgtagaaagctgaacaatagctgcccaaattgcagtatccagagataacattgttaacttaggctaataccagtaaattatttttaataacaatgtcagcattcatggttttccttacatactgaggtttatttactccctgtctctgattttttttttttttttttttccgagacagagtttcgctcttgttgcccaggctggcctgcagtggcgcgatctcagctcaccacaacctccgcctcccgggttcaagcgattctcctgcctcagcctcccaagtagctgggattacggggatgtaccaccacacctggctaattttgtatttttagtagagatggggtttctctatgttggttaggctggtctcaaactcccaacctcaggtaatccacctgcctcggccgcccaaagtgctgggattacaggcatgagccaccgtgcccagcctctgatcttatatcattcctcttaccctcagtggaagacctcagtccaagcctggctttcacccctacaccagcccatctttccagccttgtctccaccattgcccagctgttatccatacccaccatggttcagacttccatactccctgtaagctcctagaatcttccctcatctccctcatttgaccttttggaaaacctcctgttcatccttcaagacgtagttcaaatgttacctcttccgtgaagtttacccgacttcctctcccatccgcattccactggaatccccggttcttttatctatatttctgttgatctttgatactactcttttataacacatgagattgtaattaattggatgcacctgaccacaatcaagtcctaccctgggagccacaatatcattgggcaaactttagtctattgtccaaactgtagcatataaaagccgtgtcaaaaaaggaaaagctaaaacatccgctctacctgtgagtgctcttctttgaatgttcacattaattaccctgaacctggaacactttgttttaagacatggatgatcagacggtggaataaaggtcaagatgaaggatagagggaagaaacaaagatatgttctatttagtaggttcagggcaattcgtttcagaaaagtttcttacatttatatactacatgcatgactatatgcatatgatctatttattaaaattgtttttattcagcatgtgtcacatagacccaatttatttttggagagcatagactaacataaaaaataaataaatctggccatggcagctaatttgaatggtatgttttttcttttgtttttttgagatggagtcttgctctgtcaccaggctggagtgcagtgatgccatctcggctcactgcaacctccgcctcctgggttcaagcaattcccatgccacagcctcctgagtagctggggctacaggcacacaccaccatgcccagctaattttttgcattttagtagagatgggatttcaccatttggctggcagtgatgccatctcagctcactgcaacctccgcctcctgggttcaagcaattcgcatgccacagcctcctgagtagctggggctacaggcacacaccaccatgcccagctaattttttgtattttagtagagacgggatttcaccatttggctgggatggtctccatctgacctcgtgatccgcccccgtcggcctcccaaagtactgggattacaggcatgagccaccacccagccggtatgtgttttatttgagtgtgtatagatgacttttccagtgaagaacattcattgtatcccagtcaaatattaaaaataagctgttctcctggcttctataaatcagatttccacgcacacaatcctggaagagtatatctgtgcacatgcctgccctggagctatccgttagaactgtcctcacagtgacgtggaaaactttgcctcatctgtataaggtctcgtctttagagagaggagaaaggattgggaatttcaggcttgaatctctgaaggtgcaaagcttgaaaggttgagatggagagcagagtctgggaactctgtgtctctgccttggtctgtgacagatggggccgggctggtctcaaagccgttgcctagaactcaaccgtgggctggcgttacccttttgaactccccctgcctgctacaattcttctctgctctatcatgggtcccaggacagtttctgctccagactgtctgaggagcttagggaactctgaaaggaaaccttttaagtctgcttttcttgagaatgctaaccctgcaaaacttggccagacatcacattgggtctccctctgtggtgactcagaaatctcaaggagagcaggaaaatctagaggaacactcataatgttgaaagggccagagggcaggagggatgaaatttgtgtttccattgagtgggtgatatttttcatttcaaagcctgatgtaaaatcttgctggtttttagttatctacagattgagaatataaacactgctattaaaatatttcatctctcccaaatgaggccatgcacaaatttccttctatgtgcagagccttcagcaacatccataccaagcacaggcagacatccaaatctactctttttacttgaagggaaacagtgctatctctgtaggagacagaggctgagggaaaggaagagaggggtcttggaaggtcaaggctgagttgggggagagggcaacattcataggtcaggaaaggcaaaccaattataatgatttctttctatcactagcaacatctactctggaaacggttgtctaaggttatgccctttctggtaatattcagacttggagtacttaagcttagttaaaagaatttgctagcactttaaatgttggattgctggcgagaatagaaaagcctgtctcccttcaggcaaggtcctgccctgtgcttttgtgtgtacccctctgccctgagaatagctgggctattggaggttcacacagtcaataaccactgaactgcacccgtgggtagctctccagtgctgcctgctcatttaacaggtccttatggagatgggcctgatacacaagtgctggcgatcttcaggacaaacccaataaaatgagagaacctaagcttggcttctaaccttcctgggaaaaggaagtgtctgtggttttcatagagcattcagatcttttttgtacttctgtctttttccattgaagatggaattgttctaccctctccaaagtcagccctgaaccaaggggttttccatgactttctgtgaccatcaacattcaactgatgcctgtttcctatacacttcagagagagccagagcttcacaagccaattaacacattcctaagaatcaaaacttagtttctgggctgggcgccatggctcacccctgtaatcccagcactttgggaggctgaggcgggtggatcacttaaggccaggagttcaagaccagcctggccaacatggcaaaaccccgtttctactaaaaatacaagaacttagctgggcatgggagcgggcacttgtagtcccaactacttgagaggctgaggctggtgaatcacttgaagccaggaggcagaggttgcagtggccaagattgcaccactgcattccaacctgggtgggcaacagagcaagactccatctcaaaaaaaaaaaaacaaaaaaaaaaccttagtttctgaaacccataatgcaaatacatgttcctccaaaggtctcaatgttcttatctcaaaatacacattttattgcttttgaaatacatgattatcatatccctttggcatgaatttgtatgaatccttagatttaagtatgtaaaatataataaaaacaaaagtgtgtgaataccccctactgcagagttatgcaagcctaatattcaaagcatgacatattaaatattataccttaaagacagaattagaacatgaacacatgtataatgtctttgcctcaacttcaaaaatgcacagttgttgagagcctggaagagacattcaggaacgggctgcaacaagccttgctctggtgtggtcctgcttatccaattgttgctcaataatgtcccttcccggaggcatagaaggcaggcacccatacattcacacccacaaaaatgtcacctcattccccagagattgccagtctgggcattgaccttcacttaagcagggcatcagtgtgatgtggtccccctgctggaagtggaattgtttctaactctgggtgcccacaccatagagggcttgtctacacttggtctcagccatcaccccccaaacacacccagctctttaccacctgattccctcaaggcgactctccttccctctgccagcaccccttggttgtagctttggggaccctggatgtttgaaagtttcatttgtccacaatccaggtataagtcccccttccctggattctagggagggcagcagcggcatgtcgttgtcactcagcttgctaatcaagagagaaccccagaaagagtatttaggagataagaggggtagtatatatttttgtaaatagaaacttgttttctattaataattaaccatttttctgatagcaaaaacatcagcacaggtatactctatccatttatggttggttaacacacagaaccttttctactgagtagggttaataatacttagtatgtgcctagcattcaacactcacaacagccttgcgaaataggactatttttattcccattttacaggtaaggaaacagagaccagaggtgcaataactttcttaaaacgactagagggagcaagtgacagctaggacttgaacacaggctgttggccttcaggatctaggctcctaacacaatgcaccaaagccaagtcagtgccaaagttattccatacaaacggcacttgttctttcaccctttcaatgttcatgttatctctgctcttattttcatcttcattgtacacctccccttacatgtatttgcaagtctctcactttgcaaaatggaactgataagtactaaacctcctcaaaaaaagcacaaacagccccagagtgatgatgcccaaaacttaaatgaccacagcaaccagtgccatgccagtgagttttggagctgagctttggtcttgtccatagaagcttttaagttgaaagcttataaatagagggtttctatattctgtgaatgatagaggtacacagttccaattgtattctgtattacgtgtatgtgccctctttgcataaatgtgcctgacactgtagtggaggccagcttcttgaaagcaaaaaaacacgcatcccattcatctctgtatttccagggctcagcactagtgggtgctcaataaatatactgaatgaatgaataaaagtattactgcaaagatcagtaagtcccatgccaaaaaaagaaaggaagaaaaaagaaagggaaggaaggagtgagcgaggaatgaaaagagaaagagggaaagagggaaggatggtgagcctcttcagaaagacggctgctcatgcttgctctcttgggcatggagtgggtcactggctggacgtttaatgggtttacattattccttaacagtcattgtttcaaaatgaggcatctctgatggctccatgctggcttgtctctttccgcctatgacattctctcaagagtttagagtaggagaggattttagaacatgatagtaacaagtaaaattagtattttttggactccaggtacctgtttgaaattatattgtttagaatataacaataacagtgaaattaaattgttgtcttaaagtgaataactgtaaagccatgtgtgatctgaacccccgagcctgcccttatctatcaaaatcctggtgtctgaagaagtccaaaatggaaacacactctgaacagatttccggcaggagcttccaccaggttttcttcgtggcaagccctagaaatagtctggactacaagcaggtctttttaaaaccatgctcctttatttaatcatgaagatttaaagtttataagtttagaaattcagggataaaaataacccactgagtgtcaggcctgattgctaagtgctgttcaggtgtgatctcacagctctctcagcattttcatcactgccaccacttcacaggtgagaaaagtgaggcagacaacagacaagttactggtctaagtggtagaataaaaatataaccccagctccagagcctctgcactcagccatcatcgtgtactgccccgctgtgaatttcatctaggatatgccaagacctgctgatttttcgtcacttgccttttcttattaatgtctgttccttggcgacaatggcatctgctgagccccacccggcctccccacccacctcgccgcctgttctctccctcaaatccgaaaggtcacgggtacacacccaacttcagatagcatttagttagcttcccctccaacactgaggaaatgttcattaaatgctccagccatttaacaagtctatttaacttcattttcaatttaaccatgtattatttcagtttccttttcctccgtattgtatagccctgggaataagagttggaaatgtgcctatcataagctgagtcacattttatgtgtcccctcctctcaagccactgttttctctctctttttttttttttgcgattaaaaaaaatatatatatcctgtgtaaaataaaacagattcagaaaactgcgtaaaacaattcattatataatttgtatatataatgaatgaaagaaatagaactttctccttgtacttgcctcagaagccatgtgacccaagccagtcacagcccctgccaccttcaaagtcagcattgtattaacttatagtacttacatccttgtggatttttttcattgcagataatttttaacatttttgaggtataattgctatatataagaaagagcacatatttaacgtatgcaatgtaataagttttgacatatgtacatgcccttggaagcattatcacaattaagatagcaaatactggctgagtgcggtggctcatgcgtgtaatcccagcactttgggaggccaaggcaggcggatcactggaggtcaggagtttgagaccagcctggccaacatggtgaaaccctgtctctaccgaaaatacaaaaattagccgagtgtggcggtgcacacctgtagtcccagctacttgaggcactaaggcatgagaattgcgtgaacctgggaggtggaggttgcagtgagccgagatcatgccactgcactccagcctgggaaacagagcaagactgcatctcaaaaaaaaaaaaaaaaaaagatagcaaatacatccatcatcctcaaaaatttcttcctaccccattataatcccttcctcctgccacctgctccctcctggtaaccgctgatctgttttctgtcactatatatttgtcttcattttctaaggttttatataaatggaatctttccgtatatactctttttgtttgatttcttccactcagcagaattactttaaaattcatccatgtcttgttatatgtataatacctcattcctttttattgctaaagagtattttttgtacataaatatgatatctatgcttatagagcatatatatcacaatttattcattcattcagttgttgatatttacatcattttcaattttttactattgggcttttttccaaaatggttatatcgttttacctttccaccatgattgtatgagagttccagtttctccacatcctagtctgcacatggtatcattagtttttcttaattttagccactttaacaggtgtgtagtagaatttcatcgtggttttaatttgcacttccctaatgactgatgatttgagcatcttttcatgtgtttatttgccatctgtatatctaccttggtgaagtgtttgcttaaatctgttgcccattgtttaattggattgcttgttttcttattatcaagtttcttattatagtatttatatattctagatacaagttctttatcagacatgtgctttgcaaatattttctcctactctgtggattttttaaaaatttccttcatagtgatggagcagtttttaattttgatgaagtcaaatttatcaacttctatgtatcatgctttgatatcttattaaagaaattcttgcctaatccaagctcacaaagattttctgctatgttttcttccaggcacacatattatagtttatgttatatgtttagacctatgatctattttaagtcaattttttatatgatatgaggtatgaattgaagctcttttttatttgtttgcatatgcatttgattgttccagcaccatttgttgaaaagactgtcttttcctccactagattgcctttgtaactttgtcaaaattggttgtccatgtatgtgtgagtctgtttctggactctattctgttcaattagtctgtttgtctttatgccagcactgtactgttttgagtactgtagctttacagtacatcttaaaatcagatgatgttagcctctcacctttgttcaatctaaatagaaagttgttttggctactcttggtcctttgcatttctctatagatttttgaatcagcttgtcaatttttaccaaaaagcttgctgggaatttgaatcaaggttattttgaacttatagatcaatttgaggaacgttgacatctcaaaaacattgcatctcatgtctcatgaacaaagtatatctctccatttacttaggtcttcttgaatttctcccagctatgagttttcagtgtaacaggtcttgtacatcttttgttagatttattcctattttatgttcttatgctcttgtgagttcttaaatttcatttctgattatttattcctagtatgtagaaatacagttgacttctatattattgattctataatctgcaaccttaccaaacttattctagtagcatttttatagattccattggatttctacataatagtgttgtttgcaaatacagacagctttgcttcctcctttccaaactagatgcctgctatttatttttcttgccatattgcaatggccaaagccttcagtaaaatgttgaatcaagtggtgagagcagatccttgccttgttccttatattagggagaaagcatgcacccttttactattaagtatgatgttagctgtggttcttcagagatgccctttattagattaaggcagtttccttctattcctagttcacttagaattttttatcaggatgttggatttttgttaaatgcttttctgcctctattgagatgatcatacagttttccaaaattatatctgttgattttcaaatgttaaaccacctctacagtcttgagataagccccatttcatcatgatgtaattacctttattgttgtatttgatttactgaaatcatatttagtttttttatgtgttaaatattcccagtacacttgataatttgggatcccaatctggcttgttatatttagtctctgcactaagctctagctacggtagctacagtttacttaatgaccaaataacaaccttttcttccattttaaattttgtatgactttggctgagggtcattgaaaaatcaaggatgggaatacacacacacagaggcacacacatatacacacacacacacacgccccacagtcttacatggtgaggtcctgactgaagtttattaggaaaactaggagagacaggccacaggacttttcaaccttcctgagtagagctaacaggagactaagcctactcagtgagtctcagtgaaaactgggaaagagggatacggaggagaagcagtaagcactgctgcagttatggcttggaagaatgctgttaatactgctttatcccatcattgctccattgtccagtcttgacacaggacttcctgccgccttagactgaaatagaatcactgccccaagataaatgtgatgggggagacggggtttaggaagtgattatcagacacctgcatgataagagaaaatggaaagcaaaaacaaggagataagaaggaaacaagcccagcatgttcccatgggttttacacatagactcagaatatcagtagcagcagggactgtggcaacccaaggccacaatacccaactaacagataagaacaccaaggctagactagagaggctgttcatctgagagcatactggtttgttttgttttgtttttccctcttcctgatatatccagaaaatacttcctcctcccagccccgtttagcagtaacttacttccttggagaacaatgcctcaacccatattcaggccttaggttggtacagacaatggcactttacatgcgtgggactctccccacccccttcattcaatgctgcctaatgagcactcacttcttgggtctcatcaccagtcctgcactgtaattcagggagccagctgcctctgccaacagtgtaagtaatctcaggctattttataatcagtcctgaagaacccagagggggcaccagactcacctcaacctcagattatgttttggatccacttttcttcgtcttggatgaactttgtgaactttgtgtttgtgggagagcacagtgaaggatgaacaaggaaaaggaaaaaaggggtaggagaaccaaaggcaggacagcttttccttcctcttttctttcctgaatttttttttctagagaagtcttcaaatattccagcctcaacttttgaaaaagaaaaagcagaatgtttttagtaggatctttttgtttctagcttactgggagacagtgggaggatggacacttttgagcagatatgcatcacccaatcaatcatctccagaagaacatctgaatctctaaggaattgatccaaattgttaataatacttgtggtttaagacagatagatgaaacaccttgtataatcactatattcaatgtatttgactcatgtatgggacttagaatataaattttaataaagtagaggcttaagcttgcatctttgcttgtgtgtcgtactatggcgcgtaactgtgatttccttgctgaatccctttagggcaaagctggctttggtcatgatcagatttagggtgtctagcacatagtagatacttaataaatatttacataacaaacctttacatggtactgattatgtaccaagcaccgtgctaaatacctcaaaaatttaagctcatttatgccttacttgcgtaaggaaactgtcattactatctatattttacaaagaaaactgaatccagagagactgagcaccttgtccaaggtcacacaactagtaaagggaagagccagcatttgaacccaagcagtcttgctctttttatttgtttatttaatttttgtacaggcagagtctcactatgtcacccaggctggtctcaaactcctggcctcaagcagtcctcttgctgtagccttccagtgcttcgggattataggcatgagccaccgtcctccgccaaagaggtcctgctctaaacacttgctaagaatacattgacattgaatttttcagtcattaatgttatgatgcttatgaaatcgtgacatgattctgcatgaaaaatggggattatatgatgatttcattgatctaagacagttaactagacatcagaatatatcttcacttcctaagttacccactggttattgattctatgttggttgatctataaggaggcatacatttgttaatgtactccttactcaacattactaattacatttttactttaaaaagcatcagtgcttcttctcttactatatggaaattaaagattctttttgcaattttgtttcttattctttctacattctgtaatgtattagaaacatgaaattactcctttgttcttcaggaactgttcatttgaaactctccaacataaggatgctggggagaaaacattcctatgttttattttgataatgaaatattgtgtagttttaaagcttagacatataaacttcatgtgaacatcatatatatataaaaaatcatatatatataaaatatcatatatatacacacacacatgtgcacacccttgcatctaatttataaattctaagatagtcatgaacatacatttttagattctgtgacttatttggcttttaatgcaccacaaggtaaaactctttatactctgtcatatttttgtattttctacccacttaggggagactacaattatataaaagttgctataacatttttaattaattacttgactccaaataattccctgtaacattctaaatttaatcatttgactctgagtagattcgttcctcatttaatatctttgtcactttcccttcaaattctttctactgttctttactttgggcttacttttgctgtgcctctttttcttcatttctaatctactatacattctttttttttttttctttttgagagaaggtctcactctgttgcactgcagtggcgtgatctcagctcactgcaacctccaccaccggggttcaagcgattctcctgcctcagcctcccgagtagctgggattacaggtgtgtgccaccatgcccgactaattttggtatttttggtagagatggggtttcaccatgttagccaggctggtctcgaactcctgacctcaagtgattcgcccaccttggcctcccaaagtgctgggattataggcgtgggccaccgcacctggtctcactacgttacattcttaatatggttttgttagcactctctgtgccaaaatcctattttcccctcttttcccttaggcagggcatgcacagagcagatctatttcctaccaaccttttttcccatggcacacacagctgccccttggcaataagatgcagtccctgactaatgcagcattgctctctgaagattttaatccagctttcttagtctcacctagctttatgaaaaatgagaggctagatattttgctgtttcttactaagatttgcattgctcatactataggtgccctgtgtaattgctctaacattttctcttcacacaagattatccagtattctctcttatcctgcctcatccttttccttttctgtagccagttgttatgaaaggggtggccatggcagacactgttgcagtgtaatgtcaaatattatatatttaatgtgcatgtgcccgcatgtgtagttttggtttttttgttgttgttgtttgtttttggagacagagtctcactctgtcacccaggctggagtgcagtggcacaatctcggctcactgcagcctctgcctcccaggttctagcgattctcctgcctcagcctcccgagtagctgggactgcaggcacctgccaccacacctggctaatttttgtaattttagtagagacggggtttcgctatgttggccaggctggtcttgaactcttgaccttaggtgatctgcccacttcagcctcccaaagtgctggaattacaggcatgagccactgcacccggccatgtgtagttttcaaaagagccatagataggagtcgacatttgaaaccattcaaaatgaacatttttttaaatgccaacagaatacttccctgaaaaaaagagccacagatacttgttggctttctttctttcaatttttgtgatgacaaagctgttggatttgacttttgagtagtaagtttatcctcagggcctttaataacaccagcatggaatcaaaattaggagaattactggactttggctatgtatacaccaggtttgtgactgttgaacaggatgatgtttgagaagatttactgaggttttgggggtatcttccttccctgcattttggccagtttcaagtcagaagtgggcagagcctagttaattgcaatggaaaagggcaaaccaggagccagcagctggagaaccaccttgagcactggcacatagagcacagttgctcagcatggctggtgtggtggaggggataactatgacatggtgtatggccaggggcagaggccgggaagcctgtcgcagcacagcatgttgcagtgacatgatgacaggaagcctcggagcaaatgctgtttggagatttgagggaggtgaacaggctgtcagcattgaggaaaactgtcagcagaccacagtgatgcaggcgctgggctgtaggtcagaactcttaaggattattaagatcataccactttagtagggctggttacaaggtaggataccaggagaggaatatagaaatgagggacaagacaggcaattcagaacacagctcacagaagcccggaacaagactggaccaaacaagttcaagtacaagctaaaagtcatgccatcattatattgaaaagatgtgatgaaaaagtaatgtacccactgactgattttgccttattgcttgggcatagtgagaaggccctctcttcctatcattgttttgataaaagaaaaaaaaaacaaactaccctggcacccatcagagctaaatgctgtctctacctgccttccccaaccagattcatgcctggtttgcttagggattatctgatgttactagccatgtctcttcttgcctccactggcatggaaaatctgggtaaccacaagcaaacttgaccagactgctaccaatgcctgaaactgaatattatagtacaaccgtgtgacacattcaaagatgctgactgctgtggaacactgaggcgcaacagaacttcacgaaaagaaacttttcagtgcaccctctgttagccaactctttttgagtgtgcttgcaactgtgctgttgatgtagagcgaattatatgtttaattttgatcccaaaccataggtagatgcttaatttttaaaataggcagatagtgtctagaaaattagtagagaaaagtaagtttaagctaaatataaaaacaatgaacagaatgtttcctatttacatgttttgtttactttttgtctaaaccagagatgagcaaatttttctaaaaacaaaaaaccaaataaatattttaggcttagaaggccatatggactctataataggtattttacatagtccttgttgtgtgaagcagcaatagacaatgcatacaagaatggtcatggctttgtgccaataaaactttatttacaggccggtcacggtggctcatgactgtaatcccagcacttgggaggccaaggcaggtggatcacttgaggtcaggagttcgagaccagcgtagccaacatggtgaaatcctgtctttactaaaaaaaaaaataaaaaaattagcttggcatgatgatgtatgcctgtaatcctagtgctttgggaggctgaggcatgagaatcgcttgaacctgggaggtggaggttgcagtgagccgagatcgcaccactgcactccagcctgggcgacagagtgagactctgccttaaaataaaaaacaacaaaaaaaaactttttttacaaaagcaagcagtgggccagatttggactatggaccatagtttgccaacccctagtctaaagaaaacagcatttctactcacaaattttatatatatatgtgtgtgtgtgtgtgtgtgtgtgtgtgtgtgtgtgtgtatagtactgtttctgttgaacagataaaaccatatattcatggtagctgcagaaagcaaaagatacctttaagtgacttcctcctttttaatggataatggcaatatttattattttgatttagttaaatatttattgctgagtaccagttatgttcttattactcagtattaaaggaagattttaaaactcctggcagcctctgatctccaggagctcatagtataagagagctaagcaataatattgcaaagcagtaaaataagcataatacagagagacccatgtgcactgggacagtttggtcttcaggaggaggggtggatctagatgagtcctgagggccagcgcatatttctaaagacgggagagacaggagagcatctaggggagaggtgatgagaccaggaggagcatgaacaaagattatacaatcagagaaaacgaatagttaaaagaaagcaggtaactaggctagccagggcaagatgatcatgctggctgtgcctcttcaccttcatccataagatacggagagtaacagtagcttcctcgtagggctgtcatgaaaatttagaaagttaatatttgtaaaattcctggagttgttcctgacaaagaatatataagtatttgtcaaacaaataaatgctggaggtagaggtggggattggttgataagatatggtaagatggagtcaggttgaggacaagaataattttccaaaaacactttgatgatgtagctgtatagtgagggacctgtagtgtccactaccttcaggacaatagccaaactcccaactaggctttcataattgtcccctgatcccaaatgagtgatcagtaagtgaggaatgtaaaaggtaactcctgaggccaggcactgtggttcacgtctataatcctagcactctgagaggccaaggcaggaggataacttgaggccaggagttcgagaccagcctggccaacaataatgagaccccatctctacagaatattaaaaaaaattttggtctgagagctaggagcaagagcttagggaaaggaggaataagaggaggtagttggctaccaacagacatctgaattcttaaccaatgaagagaaaaaatgtaaaagtggtcccagccgcttgggagaatgaggcaggaggattgcttgagcccaggaattcaaggctgcagtaagctgtgattgtgccactgcacttcagcctgggaaacagagcaagaccctgaaaaaaaaaagagagagagagagaaagaaaagaaaagaaaagagaaaggtaactccagttccagcacacagtgccactgcaggagtgaggaagccacgtgggagaattattttgtgggaaaagctgaggaatgcttttgcacatgttgtattggaggtactggtgcccaagtggagacagcctgaaggcagagggcggcttgagttggggctagagatggacacttgggaaccatgagcacagaagagaccacaaacatgttgagacaagggaagcgggcgggagaaagagcagggcattgagtcttgaacattgctcacaccttcattgatttggaagagacaaactgctgctgtcaacccaagtttggggtaggcggaaaagtggatacagagattctctacctcctcttacttgggaatgtaagtcaaatgtgagtttcatagcaggaagagcgtgaagttgttaagtgcacagtagtccatgagaacagattttcccatcttgagcagactctgcagagccacaaacaatgccgccttatgagctctggtcagtctggtcatgggatacctgtggggatttctttcctgtcggagcagtggcttccgtgagacttggcaaagaggctggtctgaggaatgcttctggttgtgggtacattccagcccagggtggtgtcccagacattttccttttaatgaagccccagcttttttctcccttttgctttttttttttttttttttttttttttttgtaatgaaagggttgttacaagggaaatacaatggggccctggctgtgtttcattaacttttaatttaagctgttagtatggaattagttagcagacttgtgaatcaattagctagccagtgggattccattttaacaaggggagcactgtgcgctctcggatgctagctatgtgtgtgaatgcggagtttaaggagcttcgctgtttgttcgacatccgaaagtgaatcacagtccttgttcctgcctcctctactggttccaagttcactcggctagaacatgctgtgcatcacccaacccttatcttctctacaaatacaaatttggattactgaataaatccagtggaaattcatttttcatgctgatgaactcaaagactttcagagttaaaccaaaacaatgcactcggaactatagtgaaacatttgaacatttaccctttgatccagagtttccccatattctgggaagcagtaactcctgggcaattctgcagtcttctgaaagttctatataagcttaattgtccttcctcatttgcaaaccccaccttgggtttgggaagatctgacagctgctgtctgggtttggcgtacttaccccgttactggttgagaggagacccagttaacaatttcagcctcaaatttaaagtccagtcatctcaaaggaagacagtgacataacagggaggcctagctggctttaaaataaagggagaggggacagagtcagttctaataaactgtagagatatatatatatatatatatatatatatatagcattttaagcccaacttgaagaaagttgctgaattagcatcagaaagccacagaaaaatgcatagagggagagagataggcttgtgattcacattaatattttgggcaatggaatacagtgtgaccaataaaaatgattcaaatagtatgatagaagtatactactgtcggccgggcgcagtggctcatgcctgtaatcccaacactttgagaggccgaggagggcggatcatgtggtcaagagattgagaccagcctggccaacatggtgaaaccccgtctctactaaaaatacaaaaattagctgggcgtggtggtgtgtgcctgtagtcccaggtatttgggaggctaaggcaggagaatcgcttgaacccgggaggtagaagttgcagtgagccgagatcgcaccactgcactccagcctggcaacagagtgagactccgtctcaaagaaaaaaaagaagtatactattttcatagaagtatacttattggcatagaaatatgtttacctgtcaggtatggtagcccatacctgtaatcctagcactttgagaggcctaggccagaagatcgcttgagcccaggagtttgagaccagcctggacaacacaggaaaaccctgtctctacaaaataactttttaaaaaaattatccaggcatggtggttcacacctgtggtcaggaggctgaggtgggaggatagtttgagtgcaggaggtcgaggctgcagtgagccatgattgagccactgcattctagcttgggcaacagagcgagaccctgtctcaaaaaatacatatatgtttatgaatattggaacatttaaaaagcagtaaatatactatgaagtacaattgaattttaatttcagaatattatatgcacacacatatactgtcagcaacaaagaaaaaaactggatagaaaattataacactgttattaattaaaattgttatacaaaatttgagaacaacttgggggttataagaacatgaaaagctgtggtttgcaaccttcatagggtcccaaagcaagatggaaacatcccaatgggaggttaacacttgacaatcttataacaaggtctatatatcaaacttattatctatccatctagctagctagctagctaacttaccttctatccatctgtccagctattatgtatattcatgaaactcatttttaaaacatgggagataatggctctaaatttcaaagaaatgtttacaccttgccaggaaggttttcttttcccaagtcagggagtgaaagatgtctgctaattcattcgtgaacttatttacctattttttccacaagtatttattaagaacctgcccatcagccaggtaatcaggaatcctaagattaaattattagagtatttttcattgttcaagttttctcttttcagtcatattatgtgtgtgcctcctctgagcacaagagatcaagggaaactacttacaatcttgatttataataagtgcggtttatctggaagtagtattgaagttttcttacaattgagcattttttctagaagggtgatggtactgcattggtaagactatctaaacctgtgctgtcagcacagtagccactaaccacatgtggctatttaaatttaagtaaaaattcagtttctctataactgtagccacacttcaattgctgaatacccagatgtggccagtggctgtcatactgaacagtagagatataggacatttatgtcatcacagaaagttctcttggacaatgctggtctaaacctaattgctgagaacacttgtgtataaaaaggcacttttcacattttttctcttcattgcttaagaattcagaagtttgctgatagtcaactactttcttttattcctcctttccctaagctcttgctcctagctctcgaagcaataagcttttcagaatttcattatttgtcagcaccggctcgagagagcaggcatcaaagggccaacattacacacttatgtatgtttatataaatttggttaaatattaatttgaaatggttgtaaatgagatttcaggtttgcaacagcaggaaaaaagtctgtataacttcgctgtaaacatggtcattggcgttaagttgttaaactgtaactaatctggcatctttgttacgtagtcaagttccactgggttttgctgtgtagcatgcgattccaaaaatctcagtgatttttaacaagaaatattgctcactcccatagatagaaggtgaaatgatctcattcctaatttgcatttgagtagcaacctaagtactaaatcacaacccaggaattttccaaagttccttacaagtactttgaactggatctttccttagaaaaatgtgtagaaaaggaaaatacataatgactggttattattctactttctttgtgtttagaggcagcattaattttcaagtagaaattatatatatatttttaatgtgaagccaatctggaaaagctgcatgctgtataattctaaccatatgacattctggaaaaggcaaaactatagagtcagtaaaaggatcagtggttgccaggagttgaggggagcaggagatgaatagggagagcacagaggatttttagggcagtgaaatcgttctgtgtggtactgtgatgggggatccctgtcacgatccattcgtcaatatccatacaatgtacaacaccaagagtgaacgctggtgtaaactgtggactttgggtgataatcatgtgtcatgagggtcatcagttctagccagcgtaccactctggtgagagatgttggtaatgggggatgctgggcatgggtagggacggggaatacatggggaatctctgtacctttagctcatattgctgtgaacctaaaactcttcttaaaactaaaattttaaaattaatgacaataaatgaatttaaaaataaatgaattaaaaaatctattttaaaattaatggcaataaatgaatgagtaaagcatgattaatacatatactaccacccagatcaaaagaatagaaccttgccaccccaacttcatatacttcttcctttttgcaactctccgcaccttgagaggtaaaccagaatcctgactttcgtgataaaatttcttttctttataattgtatgatctatgtgtacatttctaaagcaatataatttagttttcctggtttggaactttatataagaggaatcatgacatacatactctttcgtatcttgattcttttgttaaaatttcatttttgacactctcattcatgtcttttagtgttggtgagcatttctgtaaattttggctctaactagaacattataccatctttaagaggagagctcagatcaatgcatgctactgtgcaatgggaagagttggggcaggaggaaaaatatgaagaaaatgttaaccagtgtatttgatttgttttaaaatacatttattacttctgtaatttttgcaagtgtataattttcctaggttctaatgcagtatatagaaaagacatttagggccgggtgcagtggctcacgcctgtaatcccagcactttgggaggccgaggcaggcggatcacaaggtcaagagattgagaccatcctggccaagatggtgaaaccccatctttactaaaaatacaaaaattagctgggcgtggtggcatgtgcctgtagtcccagctacttgggaggctgaggcaggagaatcgcttgaaccaggaggcagaggttgcagtgagccgagatcgtgccactgcattccagcctggcaacagagcgagactccgtctcaaaaaaaaaaaaaaaaaagtaggaagtaatgctgataacttgaacacaaacactttcgtattttcatttcaggtttaaagtattcatatatcataatttaactcactagcagagtgtacttaccctgcagtcagacaatttcctctctctttaaggaaaaagtataatctaatctggtaggggatttttcttttatttttaacttaacaccgtgaaaaatcaaaacactgtccttgagaaggcataatttttgaaatatgcaaatttaaacggtatcttccttttaagttgtgtaaaaacaagacttttgcctaagtgtaagaccagaattttgcaaaattctggacctgcctctctggcctgcctctctccggttttgtgtagggcagcaggaggcctggcaacgtgaatgtctccaaatcctacttctgctctaaactgagattttgtggtttcttttttttttttttttttcttgaggcagagtcttgctctgtcacccaggctggaatgcaatggcgtaatctcagctcactgcaaccaccacctcccgggttcaagccattctcctgcctcagcctccccagtacctgggactacaggcatgtgccaccatgcctggctaatttttgtacctttagtagagatgggatttcaccatattgtccaggctggtttcaaactcctgacctcatgatctgcccacctcagtctcccaaagtgctgggattacaggcctgagccaccatgcctggcatctttttttttttaatgttagaatttaaaccatctggaatttatattgtcatctaacatgaggtacagattgaaatttatttttccctgcagttcattgaccaatctatgctttctcactgatttgaaatggcacctttatcattctcgaaattattcatgcttatggctctttctgatgttctgttctatgctgttgtcctctatgtcttcactttagccagtgtcatgctgttttaattattgtacctttaaaatctgtcagcatctgctagcagagatactagcatgcatacacacacactgagtattcctctcttttattactgtttattatcagataaacttttgcatatatatgttaatttcagaaaagtattccattgtgattttgagattgatttaaaattaaaatttgattttgtggagatttgacatctttagatcactgactcttaccacccatgaaaatgactctctctccattaattctaaccccttcaataaagttttgccatagtcttcatatagactttgtatattcttattccatatccctatgttataacaggcatcagacctatcatttgacaccaacagctggcatccaagaccacaggaatgatgcccaaagcagtctacacccactccccactagggcccaggaggaagtgtgtttgcagccctgacctaaatccacttgtacctttctctcctctgcacagtgacctctgcctggccaaagccccatggaatgccctaatcacatgtccctctgcagaatagtcctttctccaaaatgatccctcttttattccaccaccaccataagtcaatctctagtttcccctctgggaccctgtattactctgttttcacactgctataaagaactgcccaggactgggtaatttataaaggaaagaggtttaattgactcagtactgcatggctggggaggcctcaggaaacttacaatcatggtggaaggcaaaggggaagcaagtaccttcttcacaaggcagcaggagggagaaaaaagcgcaggaggaactaccacacacttataaagccatcagatctggtgagaactcactatcacaagaacagcatgggggaaacgggccccatgattcaattacctccacctggtctctcccttgacacgtaaggattatggggattacaattcaagatgcgattttgggtggcgacacagccaaaccatatcagatcctgatagattttaagcttggtgttgattatctgattgaaataattctgaagattgttttaagctcctagacaacaaactatgaacaaagctgccttctagagaacaggatcaggaggttgggggaaggatactttagatatttccttactgttttgtgtcactttatgtctccaaataagtacttcttttataacataaaatcttctaaaaaaaagcaaacaaacaaaaaaaactgctttccccctcccaagataagttgttttaaaggaggaactattcaaatgaatacttagtactgaacagtcattcctatcttttgggaccaaggaactcttcaaaaatttgatgaaaatggtagacactttcctctgaagaatgcacatatgtacatagctacaattttgtgtaggatttcagaaaataaaaggctgctgccctcagcagagattcgtacctctgtataattggtttctggtgaggtacacatcactggatcaagattcctgtgggggcttctggagtccccagcttccttgtcacacctcatgtcgcatcacggagcagaggctgactcccaaaagttactcagcccctttttagaataagaatagcctcagaacagggttcctttaaaaaaaaataggagagtaattttacatgacacctaatgagttgaggaaaacagaactaacctagggaatattgccaagtaaaagaagtttgtctttactccgcagcctcccgtgtcccccactctgagtctctctatgactcttctacttcctctcgcctacccaaaatcttggcatccttaaggtgcacctgagtcctctccactccaagaagctttccttcgttcctcaactcaagcctcccactcgtcaaactttcccacaaaagtaacccaaacagaagagagaggtgagcctgtatagcctgggaactctagggacaaagttcaaagtagtcttcgcaatcaaggaattccactccaaaacacatctgtgtgggaggatgctgggtgtgtgaatccagcagataaattctatttaatcttattctttttttttctttttttgttttttttttgagatggagtctcactctgtcacccaggctagagtgcagtggtgcgatcttggctcagggcaacctctgcctcccgggttcaagcgattcttctacctcagcctcccaagtagctgagattacaggcgcaggccaccacgcctggctaatttttgtatttttagtagagacagggtctcaccatgttggccaagctggtctcaaactcctgacctcaaatgatccacacacctcggcctcccaaagtgctgggattacaggagtggggcgtatttttaaatgtgcgtaatacatgtatgtaatttacaagtaaatatacctacatattttatatatgtgtgtgcatatatatacatatatatgtgtgcatatatatacatatatatgtgtgcatatatatacatatatatgtgtgcatatatatacatatatatgtgtgcatatatatacatatatatgtgtgcatatatatacatatatatgtgtgcatatatatacatatatatgtgtgcatatatatacatatatatgtgtgcatatatatacatatatatgtgtgcatatatatacatatatgtgtgcatatatatcacatatatatacacacacatacatatcacagtaaaaatatagaatggagaccagtgctttacctgaatactagttaaattacttaactctgctttcctgctccctcccacctcaccccaaatcacattgcctcagaaagaagggtagagagtatttaagtgagaccaactgagtttgaatcctggctctgcgactcactagcatgagatgacttaacccttctttaagcatcggtttccccatctgtaaaaagtgggtgacaaagtggggttgctggaaggatgtaatgggtaaagtgatcaatcaacattggacatgtcgaacatcataaagatacgcacaggaagagcacagcccatctttccctcccacagtcgttatctcctaccctgtggttctttctctgcactgggtgaaatcccaagagacctcatagctttctagtagctttcagatagaagtcttcccatcagaaacagatcattctcagtatagtaattaaaatcttgtctggttcagtcatctaaacttgggtctaggcctaggtgaaacctctccccaccctcacactattccaggaaggccacgttctgcctagggtatccaccggggaggcacagggttggcctcctctctggctgtccccagctttctaggggctgtttctcctctaggtgcagtggcacggctcctcccgtcctcagcctcgacggaaccccttttccaggggttctccaggcccgctcctccagctgccctctcagttaggttccctccccctgcaggatggtcctgtggatggagttcctgtgatagtgacccggtaggctccttccaggcccacctggcctgaggcgaaactcctgcatgccctatggcctgtcctcgggcagtgagagtgtcaccctctcccacctgcctgaaattccaagggacttactcaggccctctaaggggtcctcttgaggccctcccacttcactgaaggtgaggggaaagcaatcctctcctcccccagggtggaagacacaacacacatgcgcacacgcatgcgcgcgcacacacatagacatacgcgcagcgcacagacgtacgtgcacacgcacacacacatgcacgcacacacacacgcacacacacacacacacacacacacacacacacccctctggctgcctcaacccctctttcactagctagaggggttatcagtggccaggctagcagaactgatttctggctctgtggacataacctacacgtccgtcttttagcctctcggtatggtggcttagccctttccttcagtgggtagagtgttcagcatctgtcttactgctcacagcctgtggggaatcagccaaaagtgaggctgaaagaattgccatgtaatatctttaaccctgtgcttagtaaatagtaaatgctcaatgaatattagcgatcattagtagtagtggtagtcatagtagtgtgttttcttatggtcttactctgtttgggctgctgaaaccagccattatagactgggtggcttataagtaatagaaatgtatttctgctagttctggaggctgggaagtcccagatctaagcaccagcagattcagtgtttggtgagggttggcttcctgcttcatagaaggctggcctctcactgtgtgctcatgcggtggaagggaccgggagctctggggctaaaactctcatccatgagagttccacccttgtgacctaatcacctcccaaaggtcccacctcctaaaaccatcacgccagcaattaggatttcaacataagaattatagggacacacaaacattcagtctttagcaagatctcacaatgtctgcactatatatagctttaccaccatttgaaaagtacaattcctgtcagtgtttttggtaacccactgttgtgaaatcaatttaaaggttcttgagtggcaatttgaaaatgaaatcgaagagtagaaaaaagaatagaaaaatcaagaatgcataataggtgttgtttggaaaatttgtgatttaagataattaagtatatatatgttgccattttaaatgtatgtattatattggttgctgtcaacaaaatatgaacgctacagcatctgaggttttccagttgtccaccacaatgattaacatgtgagaatcttcctgaaaaagttcaatgattaacatgtgaaaatcttcctgagaaaagttcctatgtggatgagctctaaggaatgaatatagaatgttctattccccacaggtctctgcagtgaatacagttaattgggagctaatcatgaactgctttatatttttccctaattgtctttttttttttttttgagacagggccttgctttatcacccaggctggggtgcagttgtgtgattatagctcactgccacctcacatttctgtgctcaacagaattctcccccctcaaactcccccgtagctgtgaccacaggcaagcaccaccacatctggctattttttgtacttatttttttttatgtttaatgtttgtgggtacatagtaggtgtatatatttatagggtatatgagatgttttgatacaggcatgcaatgtgaaataatcacaatgtgaaatcatggagaatggggtacccgtcccctgaatcatttatcctttgtgttacaaacaatccaattacatgcttttagttatttttaaatgtacaattaagttcctattgactatagtcacccttttgtgcagtcaaatactgggtcttattcattcttctatttttttgtacccatcaaccaccctcacctcccaccttgccccccactgtccttcccagctctaactaatttttttagtatttatggagacagggtctgccatcttgcccaggctggcctaattgtttcttgagaataattgttgtatcccccaaacataaggaggagagaagtcgttttacatttctgatgatgctttctcagagcccagtgcaaaggagaacaccagtcactgctggcgggtgtctgacattcagtttggctgtttcacttgtcctgtgatagctaactgatcttgctgtctcatcatgcattatttgcacgattggcagttattaaggtacaccaggctagaagggagtccatctggctctccgctgggccctgtactcttggcccaggatctgaaccatagcctatgcttaataaatatttgtggaatgagtaagaggttccatctatgagatgaaaaccactggtggctgataagtattcaaatggcatatcttctgtaaatgttacagaacgtcaatgccattaggtgcttgaagagaagtttaaaaatattcatatgcaggaaatgagatcatagaatttctcataaaaatgcagtttgatcaaattgaggggatggatacccacttaccttttcatagtaatagtaaatttgttatagaaaacacattttaccttccttgtctcctaattcgaggtcatgtgaagcttagctagaaggagcaaagtacattttgttctgcctgaactgtctctagtgaatacagttaccctgggctttattatgaatacctggcctgttccacaaaagcaatgaatagtgcttcaaggaagaaattttacttgttttatttcccaagaaactcaccaaattgagttgtctctactttcctttcaaaactataactaagtacagtagtaatgtcaggtcacttatgattttgacctgtgccaatctttgaatatttgaacatttttatctcctgaaaaattacttggcttgagggagacacagttggatgagcaaagaaaaaaagaaacaatcaaatgattttctgatgctttcgaatgttcataggcttgctttgaaatccctctgtctatatcaccccatcctgtttttgacttctaatctcctttaccaaatactatgtagcaatattttgtgagtcatccaaaagttgagtatatttagaccaccgtgacaatcaaacagtataaacagaactactcatctgtctgttcatcatcatcccacgcagggagttaattcctaataaaggagtttatcagatcaccctcaattacatcactttgggataatttcatacccaaggaaatttgaggcatttttgccttggaaaagagcaggtgccttacgaaaaagaaactagatttgtgagaactgggcttatgtttcaaatttatattctcaactttactctgaagagatggcttggaagaagtgacggtaacacagaattgccagtttgcttggcaaggtcaaactattccatatgttaccttgcaagaaaaatatgttaatttaaaaaatatcagagaccaaatgagaagttgaacacacagctgatttagctcagatttttgtttgttgttataccgattgccatattagctccctcttctaccacctcaaccccacccccaccaccatacagctgctcgcttgctcgttacaaagcatatttccccctgtatattaatgtcatattcagcaaatcaggaaattttgcaacttcccttctgatcctaatctggctatttttcttgagttcagtgtcatcaaatcagaaccagacacttttgttaagggtatcacattcaaaattgcacacaaacaagccccaccttatttttatgaaaagtctgcccagttacccgctttgtcccgacactaatagagccaaggctcagggtttgcaatgtaaggaaatgtggagtacattccagcatgctttctatgatgagtagatgtttgatagtacacctcacttatctgtgcctccccagttggggagcctttttcttatctaaaaggccttgccatatcaaaggtaaggatactgtttggtaaattcctctaaataagaatgccactaggagaaatttaaattatatgtaaaggaataaaagttgaaaaataaagggttttttgtttgtttgttttgaaaagttggtttcaaacttaaaaatttgcaagtgtcattttctgaattgtggaaatagagtaaaatttatcatttcttataaagttttaacattagaaaaaaagcttcttatgactaaaactaaggcatttggtaaaattttcttaccgcttctactataatatctatttctctttagatagataaagatacagatttgcagtaacattggaaagtaagtgaaaaacacagaggaaattaaaactttactataacctacctgtgtagaaataatcactgttaattttaatgcataaatataaatttttaaaaagtggaaccgtattgtaaactgatttttatcctactaaaacaaacattaagtatctgctgaaatgttttaaattttttcaaaatatatgtattttctgactcatttgctataatacttaactcattgctgcccatgtaaacttgaactgtctcatttgttaaagcgtgagagaattcatagttaattctttgtacagctaaattgttcagtaggaaatgcagaaagaagtgttaaaagaaaatcttcagccaaatttaatttaatttaaaagagtttaattgagcaatgaacgaatcatgaatcgggcagcccgcagaatcacagcagattcagagagactccgggggtgccttgtggtcagaacaaatttatagacaaaaaataataataataaagtgacgtacaggaatcagaagtgaagtacagaaacagctggattggttacaggtcagtgtttgccttatttgtacacagtttgaatacttggcagtgtgtgagtggttgaggtatggctgctgggattggccaagactcaaccactgttacagatgcaaacttttaggctgtcaatcttgtttacctattaagttaggttgcaattcatccacaaggactcaaatacagaagtatagagtccttctcaggccatatttagtttgttttaacagacgtagaagagaaaacccttgttctttgctttgtccagggtagtcagctgattggaaaggtaaccgaagtctctcaacatcaaaacatttctaatgcaaattctttaagtcgtactgttcctactcaccttgaacttatgagcaaatcccttatcaattgtgctaccttttattcagataatgaatttgggaatagggtttggaattcaagtcccatagcttagaaaagattgagtacctggcaattcagtatagttgtggattgcaataattcctgtgcttgttaagtaaccaagatttttgtgtgtgtgcgaaaagcatgtgtaaaataattgacaatcagcacttctgttggatagatgggttcctgaaagagcatatgtgaataaattttggtgtatctgatgctactttcctgttaagctactatggaaattatcttaaacattatattcttttccctgaggcagaaaatgtaaataatacattcccacaggtaacaactataactatttcctatgtatgttttcaaaaatggttcatgcacttacgagcatttgtgtactgtatgtattcatgcacttatatagggtaccctaagagatgatttttacatgagggcctatcacacttacatattcttacttcttaagggaattcaaaggtagatactttgttgtccctaaaaaaggtacatgaagatctatttccctcttatcagaggcaggcttcatatctgtagtaaaggagaaaaatatagaacatttgctttaaaagttcctctttttataaataatacttgctaacttttatgcttctgttttataaggaatttcttccttgtgctatatacaaaagttgcttccaggtggattaaacaaggcataaaaagataataaaggaaaaatttgataagtagttcaaataaaaaaattctgatcattaaaaggcaccctaaggagtattaaaagacaagtcatagggtggaaagtatttgcaacttatgtagacaacactggaccagaatatgtgggttacaaatggaataaataaagaactcgtacaaatcaatttttaaaagctaccaggcaataaaaaataaataagtgaaaagtagaacagccacttcaccaaagagagaattcaaatggctaataaacatgaaaagatgttcaatctcattaagtaataagaaaaatatgaattaaaacaacagagataccattacacacccatttaattggcaaaaatttaagcctgataataccaagttctggcaaggatgtgaagtaacaggatatttcatatactgccagtgggagtataaattgttaaaaaccacgttggaaaagagtttggcataatttgataaactcaaagttatgcaaactctatgacctagcaaacttcactcttgagtatatttctcaaagaaatgcttacatacgtgcacccagagacacgtaacccaaatgtacatagcagccctgctcataataaccccaaactggaaatattccagaagtccatcaacagtagaacaagtaaggaaattgtggtagagtaattcaattaaatattattcagcaattaaaataaatgaactatagctagacgaaacaacatgataaatcttacacacataatatagaacaaaagcatacagacaaaaagaatacagtcagattccactgatataaagctgaaaaaggagggagaaaccaagtaccttgctcagagatgcataactgaatagtaaagttagaaagaaaatcaaggaaatgataactctgcaagtcaggattgcggttaccctgggaaaacccaggggtatgagggggaggcacacacaggaatcttctgttctatttttttacctgagcagtggttacaatctgggtgtttgctctataactctttgttaaagtgtaaaatttttttgtttgtttgtttgtctgagatggagtctcactctcttgcccaggctggagtgcagtggcacgatcttggctcactgcaacctctgcctcccgggttcaagcgattttcctgcctcagcctcctgagtagctgggattataggcgcatgccaccacacccagctaattttttgtatttttagtagagacagggtttcaccacgttagccaggatgggctcgatctcctgacctcgtgatctgcccgcctcggcctcccaaagtgctgggatcacaagcgtgagccaccacgcccagcctgtaaatatttttttaaaagacgtgcagatagaaattatcttaaataattgcttacaagacaaagagaacgacctgcccccaagtcccccagataaagtaggatatcactaagaatccacacccaagtaaagtaattaaaggggttaagatgtctctccttttgtgattaacaccccgtcgtgcttgcagaggcaccgctgggtgtcagggaacctgcctgctgctcacctgaacaccccataaataacaccagctctaggacatggtccatgtgaacaaatgaagaatctctccttcagccagagggtgagagtggcataggtaacaactagataatgcttggctctgcctttttcttattgatttgtaagagttctaattgcaagataggctgagaaaagtagtctagccatgttccatgaagaagagaacatggaattaggttagtagctagcagcctcagccacaataactttattttgtttgtgcactcatcatttaagaagtatgtgagagcctacaaaattggggagttacttctcgggaatgctccattgagaaaaactgctgcctcttttatctgtgtagtcaatatcatggcctaaattctagaatcttctcacatagccagagtttagtgatcaagcaccacaaaccaagagatattacataacaataggatcgctcaaacaaatctacgtgaactaggaaactgctttttggctcactcagaggtacaaactttacacccactgaaaattgtcccaggattggataaagaaaatgtggtacctatacaccatggaatactatgcagccataaaaaagaaatcacatcctttacagcaacatggatggaactggaggtcataatcctaagtgaattaacacaagaatggaaaatcaaatgttgcatgttctcactttcaagtggaagctaaacattgagcacacatggacataaacatgggaaaaatagacactgcagacgactagagttggtgcggggaggacatgggttgaaaaaatatttttcaaatgtaactactgtttgataaaaaggaactatgctaaatgaccacttctcccagctaaaggcagaccatctacattacatttttttttttttaagacggagtttcactcttgttgcccaggctggagtgcaatggcaccatgtcggctcaccgcaatctctgcctcctgggttcaagcgattctcctgcctcagcctcctgagtagctgagattacaggcatgtgccaccatacccggctaattttatagtagagtagtagagacggggtttctccatgttgctgaggctggtctcgaacccccgacctcaggtgattcacccaccttggcctcccaaagtgctgggattacaggtgtaagccactgtgcccgggctacattacatttttactcagttaagagcaaacaataataggtgaatagcagcctgattctgtatgttaaaaatgattggtgattgaatctcaaatgtattagtccgttctcacactgctataaagaactacctgagactgggtaatttatgaagaagagaggtttaattgactcacagttccacaggctgtacaggaagcatggctgcgtggctgggaggcctcgggaatcatacagtcgtggtggaagtgtgaaggggaagcaagcacatcttaccatggtggagttggagagagagagagcaaagggggaagtgccacacactcttaaacaaccagatcttgtgagaagtcactcactatcatgagaacagcaaggaggatacgtacttgcatatatactccctgaatctaaaataaaagttgaaaaaaattttaaaaagaaaattgttgggaggctgaggtgagaggattgcttgagcccaggaactcgagaccagcctgggcaacatagaaagaccctgtctctaccaataatcaaaaaaattagctgggctttatggcgcacgcctgcagtctcagctacttgggaggctgacatgggaagatggactgagcctgggattctgaggctgcagtgagctacgatggcgtactgcactccagcctgggtgatagagtgagaccctgtctcaaaaaaaaaaaaaagaaaaaaggaaaattgtccaaggaatttaaaaattttcattttggctctctcatgcgcagtaaccgtgagggtttaaaggacagtgccagggccccatgttgttagagagcactctgttgtctttggcatgggagaggacttcagtgcaaaacggtgtatgaagtgtgttgtcagcagaagctaatttacaccctgtgctggacggagggttgcttgtttggagttgtttttcctgtggctaaaggattcctgggaatgctgttcaggcatgtctctgctggtggtatgctgtcatccttttcttttccatttacagtgtagagctgttacagttgtaaacaggcctggctttttacattgttactcactggtgtgggaacaatgtatgttaatgacataagtactgcccttgagagtactgcccaaaacagccccaggttgaaaatgtatcctcacagatttaatttttcttataaaagaaagaggtatgttccttctgtgtagagcgaactagaaatatattaaccctgcaactaacatgcagcacttcacaactcattagtgaggcccctgggatatggctccatatatttgcccacaagttggtataggccagaaaccagctgctttttcacctacgtggtgagagccagaggccagtcaaggaacaaggaactataggagaggaactacaaggagaatcttcagattttcaagcctattattgttcaatacatagtagtttaaaaaactttgacagttgtacttaaagtcccttctcatcctatgagtctctgcctctgccagtatgtgatgtttctggctcatggtgatgacaaattcggatgcaaaagtaaacaaataggcccccatcagcccatcggggcagcagccctaggcagtgacagttaaacagttgcaaagacctattttcagaggcatgtacccacacctgacctactattaagtaagcatggaaattagtatttctgttggctttaattaagtaaatattatagtttgatccacaacaccaaatctttgtcaatgtcctaaaagaaattgttcttttcaccacaagagttatgtattcagagtaaaaatgggtagatgtatattttctctgtgaaggaaaagaactggaaggtgcttattttattccaagagttcccaaagcgaggccgggtgtggtggctcacacctgtaatcccaacagtttgggaggccaaggcgggcagatcacgaggtcaggagttcaagaccagcctggccaacatggtgaaaccccatctctactaaaaatacaaaaattagctgggcttggtgtcaggtgcctataatccagctactcaggaggccgagacaggagaatcgtttaaacccgggagacggaggttgcagtgagccgagattgcgccattacatctcagcctgggtggcagggtgaaactctaaagaaaaaaaaaaagagttcccaaagtgagaccattactcaaaaatttgagatgggaggctaaattgcccctgctgtgtatttagagggttagtattgaataggtcaacaagcatttcctaagtctctaggctgaatttctaatacggtttcttagtaaccattctcttaaagaatgtgagatttgaggtaagctttgctttaagggagggacagatgtgaaccctaatactggttagaaggacataagagaagagagaaagtaaaactatttaaggaatttttttctctcatttaaggcccaaagcagcctttccttttctcggtccaatccgatgcttaaacttgcctgaatttcctctggggttaagttcaaactaattttcactgttctaagcatgcagggctcttgcacaacttcatgcctctgtgcgtgtgtttccaccagttggaatgccctttctcccacccacccctaaactcgtacatgcttatccttgcagagacctcctttgtaaaccaagaagcccccgactcccctgttacagaggtaattgctttggccttacctgttttacctcctggtaagttacagcacttagcaccttgcaattagaggtcatagatttccctgcttctctagaatgtgagattcttaaaggcagggattttatctcatttattagatttgtatcccatgtacctgacctagtatctagcacaacttagtagatatcaattaatgttcattgtatagtcctttgatgatgcggtttggccctgtgtccctacccaaatctcatatcaaattgtaatcctgatgggaggtaattgaatcatgggggcggacgttccctttgctattctcatgatagtgagtgagttctcacaagatctagttgtgtattttattatttatttattttttgagttggagtttcactctgtcacccaggctggaatgcaatggtgcaatctcagctcactgcaacctctgcctcctggttcaagtgattttcctgcctcatcagcctctcaagtagctgggattacaggcttgtgccaccacgcctggctaattttgtatttttagtagagacagggtttcaccacattggtcaggctggtctcaaactcctgacttcagatgatctgcccacctccgtctcccaaagtgctgggattactggtgtgagccagtgagcccagccaagatctcgttgtttaaaagtgtgtggcacttccccctttgctctctttctctctccaactccaccaaggtaagacgtgcttgcttccccttcacccttccaccatgactgtaagtttcccaaggcctcccagccatgcagccgtgcttcctgtacagcctgtggaactctgagtcaattaaacctctcttcttcatacattacccagtctcagatagttctttatagcagtgtgagaacagactaatacatttgagattcaatcacctatcatttttaacatacagaatcaggctgctattcacttattattgtttgctcttaactgagtaaaaatgtaacgtagatggtctgccttcagctgggagaagcggtcgtttagcatagatcctttttatcaagcagtagttacatttgcagagtactttttaaaagcaaaatatttgttcttattttcctggagtttacaacctatttgggctgacaagatgtatagagatgtgtgtgtatatatatatacacatatatgtgtataaacatgtatatgcacacacatttacacacatacatatatgtagtttcacttattctttcaacaaatgcatatggagtgctaaacacgtgcccggagctgtgctgggtgctggcacccgagatgcggactccacggtgcctaaccacaacacttcaatacccagggcgatgagagccagaaacaaaataagtaagataacttcttggtaagcaggaggaaggggaaaagattagaggagggtaaagaaagcaacctaagtaaaagttagaaggtacaaatgggcatggaatttgcaggagtggtgaggagattcatgagactaaaggctttagggagaaatttgggggccaataaaaagctatgagtacacacacacacgcacacacacacacacacacacacagtgaatgatactcagtttaacctaattcaacaagcacttcctgattcctgactgtatagaaagtactgtgcaacatattgagactcattcagagatgtttttctttctttcttttttatgtttttgagacggagtttcactcttgttgcccagactggagtgcaatggcgcgatctgggctcactgcgacctccgcctcgtgggttcgtgcgattctactgcctcggcctcctgaatagctgagattacaggcaagcgccaccatgcctggctaattttgtatttttaatagagacatggtttctccatgttggtcaggctggtctcaaactcctgacctcaggtgatccgcccaccttggcctcccaaagtgctgtgattacaggcgtgagccaccaagcctggcctcgttttttcctttgagatagagtttcactctcgttgcccaggctggagtacaatggtgcaatctcagctcactgcaacttctgcctggcaggttcaagtgattctcctgcctcagcctccagagtaactgggattacaggcatgcgccaccatgcccagctaatttttgtatttttagtagagacagggtttcaccatgttggtcaagctggtctcgaacttctgacctcaggtgatccatcagcatcagcttcccaatgtgctgggattacaggtgtgagccactgtgcctggcccagagattttgttttaagagaagatttagagtgtcaagtgctagcagttcagcgggaaaaacaaaacatatctcatatgtgtaatataagtactacatatcccagtaagcccatgaaaatataagaggaaaatataataatatatatgagaatataagggaaaatatattaatatatataagaatataaggggggccaggcacagtggctcatgcctgtaatcccagcaatttgggaggctgaggtgggcggatcacaaggtcaggagatcgagaccatcctggctaacatggtgaaaccctgtctctactaaaaatacaaaaaattagccaggcatggtgacgtgtacctgtagtcccagctactcaagaggctgaggcaggagaattgcttgaacccgggaggcagaggttgcagtgagccgagattgcaccactgcattccagcctgggcaacagagcgagactccatctcaaaaaaacaaaacaaaacaaaaaaacatatttgtgttgaaaattgagtagatacataagaggaagcacatccagagaagcttaacataaagcattgtattagtctgttttcacattgctgataaagacatacctgaagactgggcaatttacaaaagagatttattggacttacagttccacatgtctggagaggcctcacaatcatggcagaaggtgaaaggcacatctcacatggctgcactgttagagagcatgagagccgatggaaacgagtttcccctcatcaaaccatcagatctcatgagacttattcactactacaataacagtatggaggaaactgcccccatgattcaattatctcccaccggatccctcccacaacatgtgggaattatgggagtacagttcaagatgagatttgggtggggacacagccaaaccatatcaagtatataagcaggccagggattttaagcatttgcagtgggtggactaccatcttttgaaccaggagatgaaaaaatatcctcttatttatttaaacacagtgtcatttttatataccctatgtctaatacatccaatattggaagcatttgtgggtgagtttcttttgctgctgtttctcattcactttacagggaatggtctatgactagcctcttcacctcaggccagccttgggttttgtcttctgtctcttgttttcatgaggccatgaaaactgaagctcattctctagcttctgagaaattccctcagggtaaaacagctttaagtgctctgctttccactctgtgttcccacttttatttaaattttcccttataaatccttcttcttcttcttcttcttctttttttttttggagagacagggtctcaccctgttgcccaggctggagggcaatggttggaaagatatttctggaactcagaagagaggttaagactaaagacatgttttagttatccacctagagagaaacataaggccataagaaagaagaaatgctccagggaaagtcttagactgagaagagaggagggctaaagacagactctggaaaatgtctgtattcaagaaccagacgtggggctgggcactgtggctcatgcctgtaatcccaacactttggaaggccaaggtgggtggatcacttgaggtccagaagttctagaccagcctggtcaacatggtgaagccccatctctactaaaaatacaaaaattatccagacgtggtagcaggtgcctgtaatcctagcttcttgggagactgaggcatgagaactgcttgaacccaggaggtagaagttgcagtgagctgagattgtgccactgcactccagcctgggtgacagagagagactctgtctcaaaaaaaaaaagaaaaaaaaatcagacatggggcaaaatggagctgatgaacacagctaagaaggagtagtcagggaagtgttaatagaaggagggtggagagaacaatgtgggggcaaggagtggaggtcagcctctgaggaagacagggctcattctaaagattaacattctgaagatcttaagggggagcactaggaagaggaattagatttggtgtctcggtggctgctgaggactttctcaggcattttggtataatttgagaggaagaagcaagatcgtaagaggttgagaggaggacgggaaaagagagaagaacaggaaaagagcaagaatgggaaaagagcatatatagaccatgtttttaaaacatttggtgatgaatggaaagagaaagaatgattcttgatcaccaagccaggtcattgaaagatgttcttagcataagagaaatttgtaaggagcccattgacaagaggagatttgaggattgaaaattcaagataggctgagcatggtggctcatgcctgtaatcccagcactttgggaggccaaggctggtggatcacctgaggtcaggagttcgagaccagcctggccaacatggtgaaaccccgtctctactaaaactacaaaaaattagccaagcatggtggcaggcacctgtaatcccagctactcaggaggctgaagcaggagaaggtggtggtggttgcagtgagccgagatcgcaccattgcactccagcctgggcaacaagagcaaaactctgtctcaaaaaaaaaaaaaagaaggccgggcgtggtggctcacgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaagaaaaaaaaagaagaagaagaagaaaattcaggatagccaaagtatgatagttagatgtggaccctggaggagtctggaaggagtgggaccatgaccacaagttggggcttgggtagtatttcaagggaatggaaatacttcccctccaaagtcagaggttaaggacaaaaaaattgagtgctcacaggtaagctgacggagatctcctagatagaacagatgttgaaagacatgagatttggtgacttaaggagaatgggagagaacagcagcatttattacagtgaatcttccaaggaatcaactttgcacccaaaaaactaataagattgtggacaaccgaaagagttagaattgcctggattcgtggttcagccaacatgtaaagtgacatcccaaacatattcttcaggatccactctcagagcgtcttggtgtttttccagtactgccgtcatacctgtgttccctttccttttgttctctactagcacctggctgttttagagtggaattgtgtgtgtgtctgcttggaaggaaagattaatatcttgattctcttttgtcatgagtagataaggaagtgtatttttaatcagtaggtattcaaaaaatgtttactgctggccaggcatgatggcacatgcctgtaatgccagcactttgggaagccaagctgggaggatctcttgagtccaggagtatgagaccaacctggaaaatatagtgagacctcatctacaaaaattgtttaaaaaattagccgggcatagtggcatgtgcctgtagtccccgctactcaagagactgagacaggaggatcacttgagctcagcaagtagaggttgcagtgagccataatcgcaatcataccactgcataacagcctgagtgacagagcaagaccctgtctctctttctctctctctttctctctctctctctctctcacacacacacacacacacacacacacacacacatttattgaattgagagaaacaggaaattttggatattatggtggcttctgttcagcgttggatattaggggtgtcaaatggaagtataaaaaccatatcaaaatattgggtgaaggtgacagtcctaccctcgcctgtttcctgaaggtctgttgagtgagataagaaaggtggttgctatggagctgctttgggacttttgtttgacaatatagaaaaggccaaaagtataaagcaggacatcaaggaaaaaacgtatttccataaaagaagagaacatgaggtgagagtggttatgatgactgatgagaaacatattaataaatggctttataaaactctccttattctcttagattggcaagacaaagactagacttttgtgttagggaaactaaccacaaattgtggcctggagccaattaggattgttcccaacccccttgtccaagcttggcctccttagaaatacggcagtacagacgattagtaaggggtatctaagaatctctgctttctgtttattgcttcatgaaggtggttagcttaatttggtttgtcggggcactgtatacacagaaacatctcccttgggcctcttatgggtaattacagaatctgtcaaatagggctgatctgcctggagagacaaggagcacagcatctatggaacagggagttgggcagaaagtttagcaaagaagcctccaggatggcaatctgagtcatggccagatgtcaggcgagaatgcgtttccagcacatcgctgtgatgatttaagttacacactctctcctgcttgctagtttgcaaagattttccatctcaggagatatttctgcagctcttcctaagagtgaagacattctgagcatgttacattcacaatcaggcctccttgataagtattgagattcagagtcaaagttgggaaagcagccttcaattgtactcattcatgtgaagttttataatgaagagtgtatgtgtgtctctttttgcacttaaacaaaggtagggaagttgatggcaactattttccttctttccccatcaaaacctggagtataaatgtgggcgtggaaattagagggaagcctaaaatttgtactggtccccagcccccgtgtagattcatcagcgagatcccaggctgtttgaaagaatgctgggcctggagctgagggacctccccagaggcaaattgatggttggaatgctgctgcagaagggctcagtgtccctgtggttctttaagtctggaatttttctttcttttgaaaaacgtacttttggggggggcggaaatgaatttgaatctattttctaccacatgtttaatgaccgaggtgatgtattttttcctcaaattattataactcccagtaaaaattcaagcctgtagaaggtaaggaggagattatatgatgaaagtattattgattttagtggaatcatggaatttaacatatcttctttacttccaagttagtgcttttcactctacatcatgcccaacactttcctaggtaaacaagggctataaaagaagggcttttaatgtatctcttcccctgctttggagcaaggcagttacagaacaacaacaacaacaacaaaaataacattatctgattgattggttgattggttggttgattttagagataaggtcttgctctgtcacccaggctggagtgcagtggtgtgatcgtggctcactgcagcctcaaactcctggactcaagcaatccccccacctcagcctcctcagtagctaggactgccggcacatgccaccacacccagctaatttttaaaaaatgttttagagttgggggtctcactgtgttgcccagactggtcttaaactcctggcctcaagtgaccctcctgcctcagcctcaccagtagctgggattacagatgtgagctgctgtatgattctgtctcgcataattggatatattttaaatggtaaacttgatctgtataatatttggacctccctcaaaaaacaaatcattcatgaagctttggaaaggctattataaccaaataatgtgtgcataaggaaccttctccccacatctctgagccccttttcattatggaacctcacagcatccctcaggatatccctgagcccaggggaagatgagagtgggaggaatttcagtgatgggaaatagaatcaagttaaagtaaactctgaattcgatagagacagtgtgggatgaagcaacaacaaaaaaatgtattaagacgctatcaataatacattttgccagcatttttgagacgttccaaaccagtctcagaaagtttgagactgatcccaagaaaacaatgagaaaggttgagtctaagcctaaaattttggctgaatttggaaattatcagtgtgaaggctacacaccaaaaatataagaaccaactgtcctgaaagtttgggagttaagatttggggaaattatttgaaatcatttcaatctaccaattcctgatttttttgcactaagaattgaaattctgaatcccttaatttatgtatcaaatatatctaccagcagtgcagggacaatgagggtggaaatgcattaactaatagattatatggactgccttaagcaactgtataatttctgttaggatgaaaccgaaccatgttgggaattctgatttaaaatgaggtctgtactttatagatgtggaaaataaggttcataggacgaaattacttcctcaaaagcgacataactgcgttgcagcaaaaacggcaggagagtgcaggtctctaagccaagtcttggactaggttcttgattccaacagttctccagtgatgcttctgaagacactgggctgaaagtgaacagtgaccctctttcccgaatgtctataattttctcaatttaaaatttttctcctaaaagacaatggctattttaatcttttctgtttgtttgtttgttttgagacacagtctcgctctgtcacccaggctgtagtgcagtgacgcgacctcggctcactgcaacctccacctcctgggttcaagcaattctcctgcctcagcctcccaagtagctgggattacagttgtgtaccaccatgccttgctaatttttgtatttttagtagagacggggtttcaccatgttggccaggctggtcttgaactcctgacctcaaatgatccacctgcctcggcctcccaaagcgctgggattataggcatgagccattgtgcccggcgaatattttaatcttttagtgacctctgccatttttcttttcaagaacaagatgaatgagcaaatgtaaacattttaaaattaacttggaagggctttgacagatttcatttctcatggacatatgcttgtgactgtttcaatattgcaggcatacactagcatcattttcttttagcagaattgcttggtgctcctgtaatagaatgaagtgtaatagtgtgcaaacattcacaacttccatgtgctctaaaacctaaacaagtttgaacccacaagtcactttgtaaggcacatccaggctcgttgagattctaactggtggaaatagttgaaagtatatttgtcacttacaccttgcctatatccaagaaggatttgagtcttcctccaacaagaatgcatccaagccagtctaaaactgtcctccataaaatagggaaatacactttgggaatttcataagctaaacactatttccacattggtcaccatggtgaacacaaatatgcaaaatcgactgaatggtaacaaggcagggagagaacgtgcttcctataggatttgatctgctgcttattctgatcaaagtggaaactataaaggttggttggagcggatagcccaatgcctgcccagtaacagggctgcaggaattaacacggtggacgagggaaggtacagaccattttcggtggctaaatgagaaataatactaagcgataggatatcctgtatgtttagattacttgcctctgaaaacgagctccaattctttttcagaacaagtattgggaacaaactgtggatatttaatcacttaagggtactttcttctgggaaaatcgctcactcttaatttttcagttgagttagacaagggctaattgcaagaggattaaaaccttgaaaactgctttgttcagcttattgtttcaggtttccctttggagtgtggatgatgtgtttatttgacataatgaataccaccatccgctttgttccgggaaccaaaaggctatgtgcttgcccaaggaatttctcagttgtttatatgtaaggaaacactgctctgtgttattggatgggaccattacagctctttcttaaatagggaatgcagagagccgtgctttcctcactcacatctgagcagagaaaccagaaaatagccttcagcactccaaatgcctgcttgttttcaacacaagagagcaaagggaacatttattgaaaatgtgtgttcttcgcttaggaacccagagctttactttgtgttattggcacatctacttagacctatgttatatgtgtatgtgtgtatatatatatatatatatatatattttttttaagtattagattggagtgcttggcatgaatcatagattagagaacattgacaactaaccagatagtgaactctgcctctatcagccaaatctaactgccaaaacactgaggaataaagtaaccactaattaagcagcctggagttttgtttttgggttttttttggtggtggttgtttttaatacataccctgccataggatgagggcaattgtgtgaaatacatgctttgcggtgacttccagtgatgcaacatagcagtctttttaaacagctgaaaactctctggtcctttatggtttccaaaaggtactccttaaatgggcataactgatgggggattggctagtgagctacagagaaggctgagtcagagtgacctgttggagctagccccgtgtgtgtgtgtgtgtgtgtgtgtgtgtgtgtgtgtgtgtgtgtgtgtgtgtgtgtagaaaagggggagccgtgggcaaggggcgggggtgaagggaggctgcaagcttggcagaatgtttgaacaagacaaagagcagttccagcgaccaaataaggaagtgagtgctgaagtatttcagaatagaagtgtgtcagggactcaaggcaattgcggagagtaaaaataggcaaagaagaaagggcaaaggatttttgttttacttgttccacaaaataaacagggaaagaagtatctctggtctttcagctggagtgagaaaaacagatcgtatctatccctttctgttggctttttatagacatgtgtctgaagagatgtttagaagctctttcagtggcaatggcaataataagcatgcttttgttaaagacagaaaaacgcaagttgtgcattagacgcaccatcacattccctttatgtgtaatgcatgaaacttttagcccaagatgatggaagtttccaagaaccaacagaaatatctggaaacccattttcagacatgtcctgaacactgaattataactgtatcctttgagaaaaatcttacctcttaacaagccagttaaatgtccattagatacagtgtctaacttaaatatgttgatagttactgaaaaagatgtcaaaagaggcaaattacgcaaagaaactgtcagtacttgttttaatcttctcaataccatctccccaactctccagagtggccaataatatgtcactgatcctatggataaatgctgctcttattttgatactttttttgcagtacgggtggaagagaacaaagatttggaaggagaatttcagatactcctaaacataatttgaaacaacctttttttgtcctacaaaaccaacattgagaaattatttctattaaccaagaaatcaatttacttatgtctgcaactaggaataaatagaagacattcatcctgggtaagacttttgaaagccctcaataactaaattgttggcaactctaggattggcaattgaacaaatctatccttctgttctcatgcaaaatacaaaattggacagcccacacttgaatcagaaactaccagaacctgcccagaagagtttgggtagagagctaaactggagtgcaaaatagggaacacacaaagattgaccacggcatgtagatgatcttacaatgtagtgtattctggctccaaaaataacctgccccccacttaaactgaaatataaactctattgaataagctaccttgatcatgcttcaagaaaatgttaggcttatgacaaaatgtttattatcacaaacaaagaaaaaattaaaatgagacacagtgttatgcccacgaatagtcattttaatgaccaagctccatcctaccaatgcttcactagttgacttttttttttttaagcaatttaacaatagatgtcaagagcagggaaaaaaggctgggtgtgctggctcacgcctgtaatcccagcactttgggaggctgaggcaggaggatcacttgagcccaggagttggagaccaggctgggcaatataatgggactccatctctacaaaaaaatatttcgaaaaagccagacgtggcggtgcacacctgtagtcttatctgcttgagaggatggcttgggcccaggaggtcaagactgtgtgagccatgattataccatgtactccagcctggacaacagagtgagaccctgtctcaaataaataaataaatagtggtaaaaagagtatttgacttcaaaatcatacttctcagtatttgccctgaggaagtaactcaaaatgggaaaagaaatgtataagcctgaagatgtttagtatagcatattttttataatttcaaaacaaaaaatttagaagtcaaatacacagaatattctcttatctcaacaatgcaatattatgcagcaattaaaactggtaatgattaagcctatgaaggcaaaaaatgtttatgataaatgatacaataatgacgaaaagttaccttgtaaaattacacactatctgtatagctatgttttgaggactagaaaagaacatggtgaaatagtgctagtgtgttatacatacatagaggtagattttttgtcatctttattttgtgtttttcaataataaatgcctttcaaaaaaagatgatgatgaacaagcttacaggcaagaggcaggattccagagtcagaaagaactgaggcttcagagtttacctatccagcaaatataagtcacaaagttttgtgtagctagttagtgatgttgtaatagactttgccatttacagaactgttttacttactgatttgacttgtcaattatttaaaaatagcaaagctagcaaaaatagcaaaatgtcaattatttaaaaatagcaagtgtaattcttttgtgagaaaaacaatcacccacaaaaatgtaactgcagaggctccgagaccatttgtgtgtgtgtgtgtgtgtgtgtgtgtgtgtgtgtgattcctccggtatagctgtgaataatgtgaggtaaccagagactggcagagtcagcccaggattaaacaccgtcatcagcagcaccccagtttaaagagaagattcagagcacctgcatcaggatctccttctaaagccctgaatggcaattgggagccaatcctgacattgagatcacataataaactgttctcacaaagagcagttcatttaatctttccatgcttttgttttggtgaccccgctactgctgggagtaattataaagaactccaaatgattagaaagcattttgcataaatcagcttgtttgaattattgcatttccagggaaaattaattgcgacttagaacaatgcagaaattatttacacacccaggtgtcaaaaagcagaggagaagcaaagaagtaaatatatatttatagaatttcctgtgatggcttataataactattgagtaatcatagaatgttaaatgtaatctcatccaaccctctatagtggagatttgaaaatggagacacaggactcgaagtgaatcgtgcagggtctcataaagagttaatgccagagccaactcctttgttgaaaatagtagttaaatccttaatggctgttctctagagctctacttgctgcctttgccttcttgcccctctcctgtggcgaacttaaacagtacttccatcagtcttacttcgaaagacttaagagtttgaaggagctctagacaatttatagtcttgtcttaggcaaggtgattctgcttcatctagttacttatttagaatgttaactccttagtggcagaagtcatgtttctcagtaataactaaacttattggcagcaatgccatgtgcgccgtgccaaatgctttccaaagtctcgttgaatccttgcagcaattaatcaggtgtgcagtgctattattctcattttactagaggaggaaactgaggcacagagaggttaaataacttccccaaagccttacacctagcaatggaatattacgcagcaattaaaactagtaacaattaagcctatgaaggcaagaatgtttatgataaatgataaaataatagttaccttgtgaaactgcaagctatttgtatagctatgctttgaggactagaaaagaacatggagaaatagtgccagttatgcgtatggatacatatgcatcacaagtgcgtatgttgagatttagacaaagtatcagccttgggatttacacccaaagcatgagctcttaagcatgaacttgcattacttcagtaggtgttcagtgaaagtttttgaaaatacacctaaagtatcccaagcagatgacaattctcttgactatgaccaaaggtatgaggaagaacttctactttgagtaaataaaatgatgggcttccagaagccaggtatccaggtgataatttttctatttgaatatgagaatgatagttacacagataactccaaaaattacctgcatcagtgaaaatttggaggacagacatatataaattttgcaatgttgtatgtcataccagtgaaggaatctaatgatactattatttattaagtgaggatcgcaataagagttattgagtaatcaatgtctctgtatttctttgggttatgattcctgtcacatcagtatggaaaaagatttagcaagtcgcatgctttgcttgtccacaacatccaagctccaaatgtcgcagacataaagatatgcccagagtaatctactctgtaactcacagtgagggtatttagttgaatctccatataaaggaatgatttgaaggaattatctttacctaatccatcctcctccccaaagtagtggaaaatagactcaattatttcacctgaagttaaatttgcatgtgtgaaagtgtatgtttatgaaacaaatagtgctaagcatgacattagaaatggaaatcctaagtcctctgcaaaacattatctgatgagttgattacgtatttgttctctacttatttcatcttaccttaaaaccatgggatactaaggtattttttttttcatcattcatcccctttggtaaaatatcaagtatatgtatgtgtgtgtatgcagatatgggtatatatatgtatgtacaaatatatacatgtttaatgtattattacacatacagatatacacaaagagagaaaaatttgaagaattagatgaatatacgtataaagagaagttttaggccaggtgcagtagctcacggctgtaatcctagcactttgggaggccaaggctggtggatcacctgaggtcaggagttcgagaccagcctggccaaaatggtgaaacctcgtctctactaaaaaaaaatacaaaaactagccgggcatggtggcgcgtgcctgtattcccagctactcagaaggctgaggcaggagaatcacttgaactcgagaggtggaggttgcagtgagccgacatcgtgccatcacactccagcctgggcaacagagcaaaacgctgtctcaaaaaaaaaaaaaaaaaaaaaagttttagtattttttttctcatctctcaatagactgttgttgaagcccactgctctgtataataccccaacacccatttgaagagttgctgaaagttctgtgccaggccatggtgggctggcctgaggcctgatcccagaaccctccagctgaaaggaatgttagagctcagccatccagcccctccgcagaacacatggggaaactaagagagtatgagaattttgtctcaagacctcatttccaagaggactcaggacctgatgaggtctttgttatatttaaagtctaaatagctgtgtgataataatgaacctagcttaggaattgttttacatactagagcttttgtttggttttagatttttttctttttggggagggggtggggtggggaggggaggcaggtagcaaagtactcttcaccacaaagaagttgaaattgaaaaggaaatctgtaggcacttaaatgaaaagcagggcattttgctgatgaggtcaaatgatactgatcaatgggaagctctgggagaggtggctgtgtaaaggagagactgggtgacccagggaagtgtccggagctgaatgagaagttggaatcacatattcctatgttgcagccttcaacctgatactaactcattcttcagacacggagtccaacttccaagtgcttcagggatttttgttaagccttttaagggtatccaaatgaattaactattgtgtttcaccaacgctctagtaattcactttcagtgggcggttttattttcccagatgtgcagattgttcaccatggagctatgagtaattaactcataaaagaaatgtccagatgaatgaacaactgcaaagcacctgttgtcaacagctgatttttgtctccgcgctttgattatgaagagcttgagaatactggaggttgttttcttcttctaaaaccttgtgacacctgctgatttaggttcacatagaatacaatggtaaatagagaataggtggtagagcttgtctttatatctaatgaaagaaaagtgtcaaagtttcagatgaatgtcagatacccaaggatagggctgcattatgactttcatgggccttaggcacttttgcctttgtgggtccgtttctccattaaaaaaaatagaattatattttatagttgtattggtataacgatgaatgtaacccaggctggattcattattatatggtcatcattgttatatttatttatgttcactttttccttctgggtttattaaaattaaaattttttcttgggttgcccaaagtgtcagccctgcccactgaacctaatgaataaattggccctgcctaagattatggacaaagagacttcacggaaccatagctggccccatcgatttttactgtcactgtaacagagaacactgctaggcccatttcttctatttttcctgatgttgtctctgaacaatgagcagctcaagaatcagaaatccctttctcggcaaggtagttcacgcctagagtcccagcactttaagaggccaaggcaggtggatggatcacttgagctcaagagtttgagaccagactgggcaacgtggtgagaccctgtctctacaaaaaatagaaaaaaattagccacggggtggtgcacgcttgcagtcccagctactcgggaggctgaggtgggaggatggcttgatcccagaagatggagactgcaataagctgagatcataccacggcactccatcctgggcaacagagcaggacccatttcaaaaaaaaagaaatccctttctccttatgtaacactacttggcctagaaaagccagtatttgtgtccactgtgctctgccagggctgcttatgtaggggccttcgttcataatatgacaacgaagcaggtgactgaatcaaaaattaattcctccatgatgctaaaagactgtgtctgtgttctccaaaatggagtcagtttgtgaagagaatttttgtcagaccagtttattcattgctacacaaagctttcttaagtgacatgcagtgggcaaacaagggaacaatgacaccaaagttatgtcaagcttgtacttgtaccacccacaaatgaagatggaataataatgttgccacctataagctaatgaacaaaatgcaacaatgggcccaaacatgcatatacccattgccaataaattaatctctaatgagacttttgctaaaattgaggtaatgatttacagaaggcctggcttttaaagaggcctgaatttagtctttatttatggttgccgtattttcttttcacttgcattgaaaactttactttcaaaatcttactttgtcaactttgtccagaaatacatttttttatttttttatttttttaccaatcctcttaagtgaatactttttaaatgatattctaaactcttatttctctcagtgcagtcttctctctgaactcttttcatgagccatatcttattaaaatccattatatattgtaaaagaaatagccattggaaaatattcataggccaccagttcctttgaacatagcagattgaaccaaagtttaatttgaaacatcttttgataaatcttataaattgaccaaattttctcaaaatcattgaactttttctaaagttactaaaaacagacaaatatcatatactaatacaagaataatgatcttacttctttggagcaatggaattattttttacatttacgactatggaaatcttgggtaaaaaaaaaatcttaattttttttccttgaaatctagtacttcattgtatcagcagtgacctagtataactcacttaaggggcctgtaacaggcaatatcaatattattgtcaattgttttaactgtcaattatataaactatatatcagataaattcttttttttttttttttttttttgagacaagttatcactctgacacccaggctggagtgcagtggcacgatcttggctcactgcaacctccacctcccaggctcaagcgattctcccacctcagcctcccaagtagctgggactacagacgcacaccaccacacctggcttctattttttgtagagatggagttttgccatgttgcccaggctggtctccaactcctgggctcaagtgatcctcccaccttggcctcccaaagtgctgggattataggcgtgagccactgtgcctggccaaattcatttctttaattgccaatgttaccaaatattctctcctatggagcttatggtctatattcagagaattttctaattttaaatacatttattacatttttatatttaaagaaagtttaattggaatatttgacttctccttattctctctcttctctctctcttctcattccatttccatattggagtctaggtttgtacattttattttgttaaagatatatactgcaaaataatctcaatgattctcttagtagttggatatctttgttagaaaacctttaacttcagcactgaagcaaatcattatgtatttgcctaatgagaaaaataaagtacttcagataacataatcccgtttatttgacgcagaagattcgtgtattgatccagaagaatggatattcaagtttaagatgtgaagtgctgggtagaaggaggtttcagagatgacaggttaatcagagttagggaaatagacccaattccctccttcttgtgatagtcccctatgtatagcctgtcggagtccatggtttcctttgaattgacttcattcttctgaaaacggcgctgcaacaccctaagcagctccattgctgagagagttttacttcctgtatttctgcgagcaacaatggaatcatggctgatctgggtgttttctaagcaccctggaaatctacatgaaatgcgacacaagattccttgttatggtgtcaccagaggtaatattaatagtattaaaagaacaagctgaggactttatgcatgatcttacccatgacttcatgaattgccactgggattaacgtaaaatctgtaatcctcgcctaaataggccatctttgtctattatccatcactatatatataagatacaacttaaggtttttcttatgtaggataagttcaaatatttagtccactgataacggtatttcaccacttattcaggagaatcacataaacaggcaaattctcactatgcctctttagtaatccacatggaatctgtggatgattccttcagagccagcataactcatttgatttggaaaagggtgctcaatagtgagtcagattctactgtggatcaagcaggacatgtttagaagctgccttaactatttcagatcaagcagacctgactatgcgcaataaaacttggcaataatcaattgctccattggtaaaatggagatcttagggacggtgaatggatggtgaatgcactttccataaatatgtattttttactccaaacatatatattccttggagcttggactctggagttaaggatttacatctccgctcctccccttaccagctccgtgcccttgggtaagttacctaacctctctgtgctcactgtccctgggatgatagttatagtgatacttcttcatggtttctatagtcagataaacaggagaatgcatgtgacatgattggcataatgccagcccaaagtaaagttcagattattttttttactctgttttttaattatctgaaactaaatactgtgttttgcaaaaacaaaattaaaaggcaaaaacaaacaaacaaaaaccagctccccacctgctacataccaaacagtatgttaggtactgcaatggcagcatcgcactgtgtcttttcaacagcagtccagggtaaataccttaacctccacttcacaaatgagaaaacaaaacctttgtgatttcaaggtcatggaaacagtggaactgaccccactctgtccagctccaaaggccatgctcttttcaggacatgccttcactagatgatctcttcagccccctcccgactctgattttgagtcctctggaattgtctcggatgttcaaggcttacctcactctcataagctcagcctgttttttgtttatcgtagcgtggcctttctttacattccaactgcagacctggttgtcattctccctgtgacatagcatttgatgtccactgggttctagttatgtctatataagtacaaacagtcccatttcttttttcccgatccattctcccttatcttaataaaaagttgtgaacaaaccaaagagccataaagttatctttaccaataggatagatgaatttgttttcatgttcaaagtatgagttgtcctcggaggggtgccctttccctcctcccctactagtctgtcttcatgatcagataatgcatgaggctgagcctctttagaatacccacattttggttttttaaagtttctcacttttgttaaaataattactagttgttgatatggagacaaatgtgttttgtataaaatgttacacttaattacagagtccaaattcaaaatagtccaagattgttaaaagttgcttattcttaaaaatgaatggactaaaagctgatcttaagcattctactctcagaaacattttcccaaacataacattactatgaagcaatatcaggtaaaatctataattaatctgttatttccttagtcttgttcttgtttgataaatgtagttgggagcccttgcaaaggtagcaagtacaatagaagaaacaggccattcaggcaagattctgtgactctaaaaaatatagtaagagctaaatcaagtttttaaaaataacatcaaaggccaggcgcggtggctcatgcctgtaatcccagcactttgggaggccgaagaggcagatcacaagatcagaagttcgagaccagtctggcccacatagtgaaaccctgtctctatttaaaatacaaaaaattagctgggtgtgatggtgcacgcctgtaatcccaggtactcgggaggctgaggcaggagaatcgcgtgaacccgggaggcggaggttgcagtgagccgagatcacgccattgcactccagcccgggtaacactgcaggactccgtctcaaaacaacaacaacaaacatcaaaacaccagaagtgaatggaacaagatcctgatgctgacctgattatcagaacatctgttatagacaacattgatcactctgaggaaatacatagcaaaagcctccttgtagaaaatgtgccaatccagaagccaggaatcttctaggaaaatctcaagttttggtaattttcattaaaatattaagcaaaatgccggaagatatattaatattcctttgctgctacatggaaataaaataaatgaaaatatagattttgggctttaattcttaagttagaaaagcgtgattgaacaatgtcgatttgtggtagcagtaaaaagacatttacttggtttgctaatcatatctactttataaaatattatcatgttacctatgctgagcattttgagctagatagtgtgcaatacccgtcagtagttagatagatcaatcagtcgattgataaatagatagatctgtgatttggtttcactgccaatatcttctttctttagtgaatactgttggtttttagtgtctttcgttttagtgttttagtttttaaccacctatgtttcactattttcattgtgagaaaaatatgaaaaggaatgatttgaaggttactttcaccctttccacttttctccccaaatacttggcgaattgagcccaatgtttcatctcaaagtaaatttgcatgtttgaagccttaggcctctgagccaaagcctgtgaaggtaaagccagagatgcacggcctaaagcagagactctggcagatacagccagcgaagctggagggagttccttgagtgtcactcctgacgaaataaaagttcattgtgtatttattctctgcccctttcatcttatctcaaatccacagagcgctaagttttagtcaaggaagaatgaaataaaagtaatagaaggagaagacttgatcagaatcttcagtgttcagaggaggatggaatattctttttcaaacttggcagaaattctcatcagtgcttctactgatactagttttagcaattctgaggcttgttcaaagtgatggccaagatgtatccacacctcccacggttcgtgtgtaaaaccttcaaagttgcaaacattggaatattcagtgttttgcatcagtgccttaaatcttcatggatttcggcactgaaaagtgaaaactggtccacgtgtacgcatctttccgggcacctgtagttggaataaggcagacacacagagatgacagatctaatggatcatccttcttttgctgtctcctcagagtaaaggaagtgcgtatgtcttctcacagccaatcaactctccaagtctattctaccccacagtcccttccatggccggtaaacactacaggtggtaatatcagacatctgttttattctttctgctctttatgttgtgaaaggactcctaaatcataaaatcataaaatttaagaagcgtaacttaaaaatccatcagattaatcccattattgtggaaataaggaagcttcagagtcccacagttaatggcacagatcacacgtcctaactctcatctggtggcactctttagtcagtgtcccatcacagcctgcaagaaaaccctgctgcaggccacgtgatgtcattgctgcagccctaagggccctttgacatgggcgtaaacaagctgagaattcaaagaaaggtgaagctaaacagggaaatactgttagaaatattagaataggcaaagtgattttcactctttaaagtttgtgttccaggacaatgaattgttggtctatcaccctctcaaaaatgcaagagatgataatgctttgtattatccccagaaagatgactatggtcagtatattattaggttaaaaaaaataggttacaggccaggtgcagtgggtcatgcctataatcccagcactttgggaggccaaggcaggcggatcacttgaggtcaggagttcaagagcagcttggccaacatggtgaaaccccatctctacaaaaactacaaaaattagctgggtgtggtggcaggcgcctgttatcccagctacttgggaggctgaggcaggagaatcgcttgaacccaggaggtggaggttgcagtgagccgagatcacgccactgcactccagcttgggtgacagagtgagactttgtctcaaaaaaaaaaaaaaaaaaaaaagttataggctgagtgcggtggtcacgcctgggaggccgaggtgggaggatcacttgagatcaggagtttgagaccagcctggacaacatagcgagacgttgtcttgaacaaaaaaaaatgttttaaattagctgggtatgatggcacgtgcctgtagccctagttactcaggaggctgaggtgggaggatcacttgagcctgggaggtcaaaactgcagtaagccatgactgcaccactgcacttcagcctgggcaacagagtgagaccctgtctcaaaaaaaaaaaagttacaaaattgtatggaaacaattatctaagctattttaagtgtgtgtttaaatacacatccaaaagcctggaggactatattttaggcagctaacaatttatctctgggagtaaaatcacagggacattcaattttggtttattgtttaaagaacaatatttggtttttaatattttacagacatcgttattcatttaaaagtcaataaagatatttccgagagaggaatagactacctggctgaagacagtgaacctagcaatgctagtgttagatatcagtaatgacggcaggatacagttacagtactaaaccctttaaacaagtggtctactggctattcaaaactagttagcatttattggcagttactgagtgaccacgttaccgaaacagcctggcacaacagtaagttcagtaaatggtagatattaccattcattcattcattcattcatgcattcattttgttaacagcttattgtgtgtgaaagatttggtcccagtggccaaggagcacactctggaaggagaaagaagacagaaattgttgtgacatggtgtgccaacccagctactggaggattatacacagagccaggggtgtccttagctgatctggtgaaagaaaagttggtgatctggatttagggctaagcccacaatctgtcacaaattttgcatagaatattaattctggaacgaatgagtccagttcctctttgaaaacacttctacagaagttcctgtgtagatgagcgttaaaataagtgactcagggcctccagtagtttatgagctaagaggatcacaggataggatagggaccgggttcctcagatgttgctagatcaaatgctttactcttctcaccctaagggctcctgaatttagctttttattacacagaacccagtaaactaattaatggaaatctaaaaattatccttcctcttcttagaaaagaaatatactgcatgatgatttgtgcttttcgatttaatgtcacacaatcgtttttacactgtatgtgctttccctccccacagccccagtcccagccccagtctcgcagttccattccttcagggcagcttccattctaccgtgagtttttattgctttcccctaaaacgctgccctggagtcgcgtttattggacactctttagtctgtaaaggaaaaaaacacaaacaccggaggagaatcatcctaacaagccgacaacatatctatgggcctaaaaaacttaaattctttcccgttattagcacttctcgatcgttccaggaaagcccgatttgtagcttggctgccccaggaaggggcctgcgaccagaaagatgcaaagggcgggacaaggttacgagtgggtgcggggaagcctccctaacctgggggccgcgtcccagagctgcgagccacgcctcctctctcccgcccgccgcgccgccggactcttattttgaagggcggcgggtgaaggctcggagcctcctgagtcacccggcgggcgaggtataaagcccgatacctgccccgcgcccggtccgcggagcccgctgcagctcccgctcgctccggacgcggaatcgggcagcagcgggaggcggcccggagagccgaggtaggcgcggggaatcggccctgaggctggtggaagaaatgtgtgaattaaagggagtgcagcgtgcagggtgggccgcgagtcgggagtgcagggctcgggacagggtgggggcggggaggacaagagactcgtcagcgcactttccacccggccggttccttcccgagccctctccctcccccggcccgcgggagcacagatccctgaaagcggagctccagataggaatgtctgcatcatcttggcagggcccagacgggagaagatgctctgctgccacggacgatccctcccgctctcctaactcttctctgaacacctcgcacccccacggccccccgcccctctcttaatcttggccacgctccctgaggggtcagacctggggtgggagagcagagaaagcggggctggcagagacaggggtgagggccgggagaggcgatgacatcattccctggcagctggcggggagagggtggggacggaggggtccccccgacctgagccgagccctcccttcccaagcccatcctcctttctttgggatggttcaccccacctgggcgccattcaaaggaagtttgcgcgtaactcggggcgtcctttccccggccgggtgctgtgcccggcccgcagtcggtgtttcttctgggcctgggggcggcgtggagccggcggctcagtcccctcagtcccaggccttggcagccgctttgttcacgccgggcgcgggccgaacccgaacctcagctgcagcactggcagcgcgcaccggccacgcgtgggttcccggccacggccgggccaacaagggagggtcccgtgagcagccaggctggccctccccgggcctgggtgagctcccaaagctggagcgcagggctctaggccggccccgccccggggctgggggcttcccgcccgtttgtctcattttaacttttgggggcagctctgtcccgaatggtgagtggtccagactctagaaaggggtttggtcgcttgagcccggattgaggcttgggacctttgctctcttgctggggacggaagggggcgcgctgggcaggagagggggcgtctcggtcgggtctccctgggctcgggcatcttcccaccctgcggagccgggtcttgcgctgcgtgccccgaacaggcccgggcacaccgagtcccgttactggtcttcaggcgaaattccaggacgggtgtgcattcatcaacctgggagtctctaggagccagagatgactggctctacattttaatgcgtaatcacagagaaactagcacgagaaaaggacagagggaccgacccaagcttcagagacatggaataatatgatcctggttcataagccttgaaaagctcccctccgccaggttaaggaatggtgtcaccagccttggctgtgaggataatttcttgatttgtgttatgcaggctcctgtcaggactgtctccttaactcccactacctaaggaaaagatagccagagaattgtccagggatttgggtttgggttgcttctagaaagacagcatctttcttgctattttttttttcacatccccccaaaacaatttttttcccccttcagacttggcagactttgatttagataagaggtttgagttaatttgattttccccatgtctgtttagatcaatggatataggagatagtttgaagctaatgtacccctatgcctttgtgtgagtgtaagatttataacttgagggaggcagttaataaatagcacatccttgaaccataaacatacgagatagacaagagctagataataaacagtttttcccccaatccctaagctttacttattttttttactgattcttgtactttgtcattagaaaaaggagtggggttggtttcccagtgaccgcattcattaagaaactgggcatgtacagcaagtagcaaaatatgccaacatccacaccatctctggctatgtgaaaacttggtgccctgtgtgaggagcatgggggatggttggaaataatgcagctttatttttattgtgattgttggaattcatgaatcataaaattctgatagctgggatggtgtggtagctcacctgctttaaataatgtaataacgacaggcccagtctgtcccaggtgaggaccactgacttagtaaacaataaacaggtgtcctactcatagtagccttagtgttgcttcagtagatccttatgagctctagatagtttttagttgacttttaatatttttaaaggtaacaataggccgggcatagagactcacacctgtaatcctagcactttgggaggccgaggcgggcagatcacgaggtcaggagttcgagaccagcctgaccaacgtggtgaaacccggtctctactaaaaatacaaaaattagccaggtgtggtggtgtgtgcctataaccccagctactcaggaggctgaggcaggagaatcacttgaacccagcaggtggaagttgcagtgagccaagattacaccactgcactccagcctgggtgtcagagcgagactccatctaaaaataaaaaaaaaattaaatgtcaccaccttgcattgtacttgatcttcagaattttactctattgtcttaagcctttaaaactttgctcatgaactatattatttggactacctttgagggtagttgcatttttgcatttttgcaaaatattattttccctaggttacagtaaacctttgactctgttatatttgaagcaactaattattcctgaaacatataaagcatttcctggcaatgttggtggagttcatactgctcaaggtgctgaagtcattatttcaaggggaaattattagcgtgttccaacagttcttaattgtccaaacaattgttgatttcccccctttccagatttctttcacaatcattgggaactataaaaaggtgtattcgacattttcttttgtgtatattttccacttcaacaattttgtatcaaaacgtatggcactttttcagcacttatttcaagagatccggataaactctgagtaatcacaattcactatacttcaaaaattgcctcccattcagtattttacaaataatcttctacaagtaaatggggaaaatagacactaaccatatactttttaaaaataatacattaaaagagcactaaagcgttctttgaaagtgctcctggtactatatacgtattggctcattctagcaatgttcttttgagacaccatacaagaaatggaactcgaccagatttgagaaaaagctgcagagaaggtgaggatttgttccagggccatacagagaggaaattgagacactcatttcttcttagttcagtctcccaggtgtttagccctagatctctttgagattgcacgaatttaagggattttttttaaaaaacagggaagctctgttatcaaattttaagagaggataaagaattagagatggtagatgagaaatgtttcatccaaagagttttttgtttgttttgttgtttttttgagacatagtctcgctctgtcacccaggctggagtgcagtggcatgatctgggctcactgcagcctctgcctcccaggttcaagcgattctcgtgcctcagcctcctgagtagcttggattataggcgtgagccactgtgcctggctcaaagagttttaatgaatagaaaacagtgacccattcttgtagaaaagacatggagataaaatgaaataaggagagcctgaggtgtcagggaaggagaaagagcattttgaaactggtggcaggtacaattctctgcctaactccgtggactacttagggcacagatttcttcctgctcagtcagtgttagctgccttcctggttatgtgctttagggttgaccgtaattggtaacataagccattccagttaggtgagcctctcttccttgtgtattttggataatgactacgaggaaacaagatggaaatgtgggatggttagctaatgtcagtgccgagtctccctgctcaatgcgcgttagcccaactgccaaagctctgccactatggtaagtgaagatggtgattttcagtttggcagagactgttggaaggcgtaatggcttatttgatggaaaagatttcctgctgcgggagaagctgccatttgcagacaaggtgtgtcagccagaagaaatgagcaataaccgttttctggtttctactggcaaaagctttgtatttttttcatatagaagtgttaaaaatagattcataagaaaatgcatgaaaccaagtaaaaagtacagacactgaaatttcaccaatgaatgggagagaagagagctaacctttgttgaatagttattgctaaccaggtgcttcagttctcacaaaattgtgtgaggtaggcccgccacattagagaacggggatcaggcaaacagagatgaagtactgctggagcgccacgcaggagactcttaagcttggcgttgacgtctatgacattcggatgcctttgtgaggctgtcaaacctactgcgaagtaggcggccctcagctttcagatgggttgtgttctgattgtgggtttgtaaaactcattgctgggaaccctgaacacactttttcactgaaactatgtcatatttagtggtttcccaggccagcccagaaatcatagctgaagtattctgtcttattaatagtaccatagaaccaaaccactatatataacatggtttttgtgggaaaatgcactcagagctccaacttgagttttttaaggtttttaattccagttacaatggcaaaagggactccaccttctctctttttccatttaagccctggagggaaaataaaggtacacagagatacatttcctttcacgtttcctcatgctaacagagaccccaccctggactgcagagcgatggggaggggggatcctggcagtagctggctttgtgacaacagaggaaagagaagagggggaagagagcacaggtagcggaagaagtgaggtctagatgtcatcacctatgggaccaattttggatggcttatcaatatgagctgcaggctgactgacatcgtttccttactaaacatcatttttactgagaacttagtaacctagacctagacattaatgttacttagttgtatgttcagtattttttaagtgaaggttagtttttaaatagtcttcagtagtagaaggaaagcacatatgtagacatcttatttttctttttcatgccagtctactgaatgtccaaaccagcacctatcggtagctgaatacactcaaggtaaacctggatgctaatggatatgattcgaattaatcatagaatatataccgttcgttgagtacttcaaaccagaaaatgtgctaaaatgttgaacacattttatgtcatttaatcctcaccacaatcccacgtagtgagtactatcagcactcccatcttaaaaatgatgaaagtgagattttaagagggtaagtaatttgtcaagatcacacagatcagaaatggcaagtctgggacctcattaattcaacaaatatttttggagcaagtcctgtggcccaggctctgtgttagactctgggagtaaagcagtgaatgaaatggacaaatatgccgaaatccttgccctcgtggagcttatatgccagtggaaagagatgaacagtaagcaaaacaaactaaacagctagtgcctcagatacagttatgtgctatgtggtaaaatagatctagggagcatgaggaatgccaggttggggttgcagttcaggcaagtagagaatacaggctgaaggacagctgtgagataacaaaatcagtccaggagtacatacgctattgtttctcgcagcaacccattttatgtcgtaacaccaaatgttgagtacatgtcaccctcatcagtcactgcttctactgcagcaagtgactggggaggtatccaagaatgactggtgaagggcttggccttttctatcccaaggtcaggaaagatgaggacagttgctggagggatgtcctagagcggctggggttttgtgcacaagcagagggcttgacctcagccaagagcacagagctgattctcctgtagccccagaaaacaggcggaatctgggggcacagatgagggctgggtggaaggagcaatggaagctcgtggaagttctgtgttgcttctgttttcttagtggaatggggagtgtggtcatcagtggggagcgagggtcggggagggagtgcggggccgggggtgcagtttgaggagagagatgtgaaacagtcacctggcagaaagggagcctgaatttagctggtgaaatgtacactcaggatctgcccatggtcaaattctgactcttaacatccttccacagtatattggagatcagaattctctagttcacttcttgaggagagagattatcttctaactccttttttttttttttttttttttttttgctgtgtcatttacttggagcagagtcctgcacttactatgtgtatggttaatgcttgttgagtgactgctacaggaaacctacacacttgtccagaaatttcatttaagcttttcgtcctaattgtcacattgttctctcccttttctgaaatgctgtgatgttcctagttcccaaaacagtacttgtatagcaattactgttaattatttcattgagttaatctcattcccataacggattaagttttagactaagaaataattttttttgtttgagacatgaactcactaccttcacccaggctggagtgcagtggcatgatcatggctcgatgcagccctgacatcctgggctcaagtgatcctcccacctcagtctcccaaatagctgggactacaggcatgcgccaccacgcccagctaattttttgtatttttaatagagatgaggtcttgccatgttgctcaggctggtcttgaactcttgagctcaagtgatctgacctctcagcctcccaaagtggtggcattacaggtgtgagccaccgcgactggctaaaaattcttaattgtatactcttttgtagtattctcttgggaccacctaagtcaagcctcattcccaccagatggtgcccctgttgggggcagtgaagaagccttctatgtctgtttcatgactccttcttggctggcacactgttgtgggcgctctgtaggtagtcaatgggaaacgggaaagctacttgcggttagaataatacgagaactagatattggtaatctcagctgagcgaatggcaaaggaactgatgaagcaggtggattccaaggctagttaggagaaggaattgactacaagtggtgttggtgggatgggaggggtgagggaggggggatgggaggggtaagggacgggggtgcatcagaggttactcccagggctctgccagaccctgggtagatggagccgccgttttacagaggtaaggacaagagtttagttttgaacattccaagtggagatgtccaggacacaattatatacctaggctgccattctgggaggagatctgagtgggagaccatgatttgggaattatcaccacagatggtaatttaagccttgggagaggatgagtttgcccccaaagagagcataaagtaagaaaattgggctctccgtgtttcaaggttgactaaagatcctgtcatttgactaggctctgctatagtctgcaaaatctgcccagggacagaatattgaagtaaataaagtgtattccagtgaaacctcaaatagattgattcaaaactggagttagaaaaacttgtggtttttcttggtaaagcttcattttctatttgtcttcataactataaatggatgtatttgtgtggaagatgtagattttttttaaaaaaaatctatttttggctctattaagagacaaaatgaatccaaatgtattccatacttctctcacattgcaccattttgttatgtaacagagaacgtttgagtacatactgtccacaccagcaactataaatctgtcctggcaagtgactgtaagatacccaggaacaagagataaggagctcgcctctccagggagaagcttttatttgcaagagagagagtgatatacaagaacttgcaaatgtctttgaagggcagaaaaaatcagctagggctaataaggcagctgtccaagttcatgattccttggcccttctttatacacaaccaccaagagttgtcagtttgcaaacctagaaaagtataccattgtaatatcagttcatctcccgcttttccagagctactcagaagcgtggtggatgcttagtgaaacgaccagaggtgtgaagctgccagacctttacccagatcaacttctttgactcagggtacaaatgaacaacgtagtctgacagctcacctaaaagttatttggaatgattttatattgagagatttttttaaagcctaaatttagattcatcagagcatatcaaggttgagatatgtgaaaggcagtgctatatgggagggtcaagttccattcgtttaaaaataccaggacatttgctgctgtttagtaggggagttgggtagggtagatatcctcacctccactatacagatttatttatttatttattttttgagaccaagtttcgctctgttgcccaggctggagtgcattggtgtaatctcggctcactgcaacctctgcctcccagggtcaagcaattcttctgcctcagcctcctgagtagctgggattacaggtgcgtgccaccacgcctggctactttttgtatttttagtagagatggagttttaccatgttggtcaggctggtctcaaactcctgacctcgtgatcctcctgcctcggtctcccaaagtgctgagattacaggtgtgagcctctgcgcccggcccactatataaatgtttaagaattaacatgtataaaggttgggactttcccaaggtgagctgttggacctggatctcctgaggccaactgtgtttttcttctcagcacagcaagcatcctttgagatgcagagtgatcttaccacttgaaaatgtgcatcaagggcaactgcagaattttccaaaagcttaagcacagatggcaaatctggcaaagtcaaattgagaacactgactacatgttcaggaggaaagtttttaagggtaaatgcttaaaaatcctgaagaccagtttatttgggaaagcaattccaatggaaaagtgcggttggcttactgagggaaccacacagtggcagtttctacaacttggccagctgccctgggctggcagttgaggagaaaatgcagcagtggggttgagtagacacctcagccacggagtgacagtcattgtgttctaggtaccacctgaccgctctctgtctgctccttctgtggctctataatatctgagctcctgggtaagctccatgcagcctctacaactctgcttggagctcagttttcctatgtgtttattttgattttgtctacttattaagttaaatacaaatctgaaaatgaaagaataatcaccttggactcctgaatgtttgctcaatgtcatttagctcccattgtttcctgtcaccatagcagtctactgaaatctctcagcatatatttcagaattactctgatagtgaaagatttcctatcctatgtagtccaacaattattggtttattatgtgaaaaataaagcaagtatgtagcatttacagagtaatccagctccactgttaatactgtcatttgaagagttagcaaggaatgtgatgaagactgaatatcttgaaacaaagtttggttgtgcagttgctctgctatgaattatgggtctgattcccctctttatatgtggcttttggattttcttctgcccttgaggtaatctgctcctcctttcattcaccgtgcttttaggtttggtttcagatacagcatcccttctgctacattctttaaagttaaaaaaagaaaaacaatttcacttttattggtgatgggcattcaactgaaattacaaatcgggaaaacatgacattccagctcacagcagtctgattaaaggtggaactcttatgaaaccacaggatctgactgaacatatggatcatcttctggcaagcttaacagacacctgatgttttccttggccatccagaaatctgcatcctggtgtagatatcatgagttaatgatggagtcaagtgtagaaatgtgtctgggacttgcagacctcttgctttgtgatactttcttttattttcttaactggctgagaaaatggctgtcactccaagtctatcttctgatgggctggtagctctcattcaggccatccacagccagctgcctttccccagacaacctacattgccttgagtcttctcttaaagcaaaaagactagaggagaggagtgctactttcttctcagccttgctgtccctgtcatgtaaggaggtacttaaaaagcattcctatccagttctctctatctgctccgtcttctctccatgccctcatggagtacttggtaaaaacatttaagtagatgactttatggaatatgattccccggttttggagaaataaaaagatgaatctcagacatcagtaagggccacattctagttcaaattataagcctgtacataatcagtaaaactatattagaaataaaagcttctcaaaaatcccaagtgctcgttacccaaaaaatgatgatagacgggggtcccacaaatgtgtagttgtgtatatgtcatagtatacgaaggccagggaaatacatagtgccacctgacctaaccagctgttaagcataattactgtggttttgccagaaaggaattctaaatgcaggaaggtttgccattagtgggccacagaacatgaaagacttccctgcaaaccttttagaaaatttatgctagtttatatttcaggaggtaatacccattggatatactctaatttgggaaacatgggatgattaatgaattgatacaacctctagaccaggggaacagaagaaagtttggcttgcaaaatcacaggctccacctggtcagcgcttatcttccttgtttagctcaagttaggtaagtttacctaatactccttaaaaggagtattttaaatttatgtttgacatttaatgatttcagatagttcttggacatcaggataaacaaattcagtgtagcacatacgtagtataagaattctgttgatataatgccgcagtcatagttgtagcccattattccaggtaataatgatgctacaattagaaagttttccaattgtagttttgatttgcacagtagtaattgctgtttctattttcataggcaaggagaatccacacatgaattagaggctttccatattaggctttttggagacatagacatggtggtgatcgcatggggtgtttgagaaaatggagactaattgaatgcaaagtattctgtggggcaagcagagtaaagaatccagtcaaatgatgtcagccaaggatggcaagcccatgcccgaaaaactggcagcagctcacccataccaagccacctgagacatttcctgggctggaaacaacgttacggaaattgaacttccgtgccaaatttaccacacctcgccaaagcctgggcacctctcttattcatgggtgcctcaggagtaattacagctttatagcatatctactaagaactttagtgaaagtgaaaaggagtcggtaaccttgaattttagcaaactagagaaggaagatgtgggtgtcctttcctcacgcgttaacaaggatgctgttaggttgtctatctactctgaatccctacttaggaggaaagtcacgtatctggttgtgcaaatcaaagagctttgacagtttgttttttgtttgtttttatttgggtgcaatttttctagaagactaaataacctgtaaaagattaaaaaccatgattgagtgtgcctagaaataaagaccacccttgactgggctttttctacccaagtccaagtgaactgctttatccatttagtcaatacatattcagtgatgctggttatttacaaagtattttatctacattctgtattaattctcaacagtcctgtgagatcattgtttattcttgttaatacacatatacgcacacagaagagagaagtggggaaccccacaagccttgagaatttcaagaatttgtggatttcagaatggttgagcagctcatagcttttctaacactgaacttttctctctccaagtcccagtcgctcgtcaaaaactgtgccatcagcgcaagaccctgtgatttctgtggtattctaattttatctgagatttattagaatatatgaggtggaaaaaaaagttgtgcaacaggagattggactctggcatcccacagcgtatcttccctgccaacttcctaataaagggtgaactccaaatattaaaaagttattaacgtgcttgaaagtctttccaaatgcttcaaaaagctagcagacacatccagtatcatttattcagcaaacatgtactgagtttgttttgtgctcagcattcccgactaagtaggacattgaccaggccatcatgggttaggctcggaagggaggggcccagatgcagaatgaattgattagttctgtgggtgaaacagattcagtgtcctctgaggagggactgaccagctctgcctgggggagtaaggagaagcttcaggagagaaccaagagctgagagtggagagtttgggagaaggctgaagctgggtagagaagctggaggggggagggctgtgtgtccggaggatggcaggtgactggtgtggctagagaggcaccggagcagaggaggtgagggaggctttaccagctgtggaaggccttgctttccacacccaaagtgccatggaaaacatgaaaatgtgctttctatcaagggatacggtcagaaatcgaacaaaatatttcctacctgtctatatcattggagaaattgttctaggtcctttaaggaattttaggacccttactaacacctttcttcttttccaatagcatcatctgtcttagataatagttggccctctggatccctgggttccacattcatggatttaaccaaccacagatcaaaaatatttggaaaaacaaaacaaaaacagtaatacaacaatagaaataatacaagaaaaaaagcaatatagcatgacagctatttatatagcctttacattaggtattataagtaatctagagatgatttaaaatatacaggaggatgtatgtaggtgatgtgcaaatgctaggacatttttttatcagggacttgagcatgtgtggattttggtatccgaagggttcctggaaccagtccccctcaaataccgagggacaactgtactcacgagacaggttgttagagtttaagagattcctaaatcataaaacctcttgtaaaaaggaagacttatacatacaaagaactcagctagtcaagactaagaaagtaccagtgggaagtaaagccacggttttaaatagtaatgtaatgaatgcttcccaagggcttgaaagtcgtttgtcttaagcagcacttttgccaattgttatactactgatttatttgacaagccccctttttagttgttagtgaaaatctcagaggtatcacagatttcaaattaatgtggtctcaatcagtgaggcttcctcttgcaataatctgagatggcaagtagctgttctaggatacctctttttgctactcttctgtcccttaactgaatgtcatttcaataccaagtcctcttctctaatatgcattcaaccatgcatgtacaaatattgacttgtccctttgctcaaccctaagcccactgcacgctttactattttcattcttacataaaagatctagaacagaaaatagattggaagtactatatagatccactacatacagtcaaggggaagtctcaagttttctcatgtttccttttataacgtggacaactgaaagttaaatatgtccgtttgatatgggtaatttaagcagctataggtacttggtgattattgtaaacctaagaccttaaataatacataaggaatcaatttcaacactaataacatctgatcaacaaagagttccttttataagatgagaacggcatggaattatttctagttgccttaaatgaattttaaacacccgttatgcgagggagagtaggtatggtctgtaagaggaactccaggaagcccatgtggaattttgcagtttcctctttacaggtgacctgttaaacagcctgcatgtcatggtagtgagatgtaacagaaaagctatgttaattaaggtgactgattaccattcaaatacatgtaaatcacagtctacccagaggaagataggagtcctctaactgcaggcttcttccgaagaattaaagggctttctgaaaagctgaggctctcaaagtgtgggtatggtacccacactggtggtgtcagcatcaccatcactgggtacatgtccatggcatccagtgggtaccaggacatccatttcttacccactactagaaataagcaattcgcttacggttagcaatattaccatgaaaaaatgttaatttgacaatattgagaccaaagcaaaacagaattttgatatttgctaaaaaagaaaaggcctgaaattagtgggctggttgaaaggggactggaattgcaagctgctcccatctgccattccagcttttaaggcttcttaattgaattggaagctcagttgaaaaaagaaaaggatcatctattctttcctctgttttcagataaagtcctaagaacttttttgagggcaatttatacccattaaaatgtcaaattcacatatcctttgacccaataatctcatttctagacatgtttgccacagaaaactcaaaacaagtatacagtacaaattagttgtacaggcagctttattgctacactatttgcactaatgagtacttgaagagagcatgtctatcattaataaagaatggtttatactatggaatactatgaggccattcaaaagcatgaaataaaccttcatgtaccaacatggaaggatacccatgatacatcgttgaaagatacaagatcactgagggaaaatgtgcatatgcttcatccaacttttgtgaacaaaaacccaaacatgtaaacatatgggtgttgtaagtatttatatttgtatagtaaaggttctggaaagatagcaccaagattttattggtgttttgccctgtggagtggaattgtatgaggattggtggttatgtgggaaattctttacatttactttattatcgtactactttcactttattttttaattaatattttatctttaatttttgtgggtacataggtgtgtatatgggctatttggatatggacatgcaatgcgtaataatcacatcagggtaaatggggtatccatcacctcaagcacttatcctttgtattacaaacaatccagttatactcttatactttctgatacttcagtttctcacaatgaatattccttttctaaaaaagaaaaaaaaaggaagaaactaagtcccaggcatattaagagagagctaattagctgtagaactaattctgacactctatttcccaatcagtattattcagaattattttttacttccctgtaatagttactcaattttagagccagaatttagcctaatctactcatttaacctctaagaaaactgagcccagggggtgctaagttcctggagagtggtcctcaggtggtgactgaggactgagttagcctcctccggcaaccctacccccgtcccaccccaccccaccccaccccacccctgggcaaagtgaaagtgaagcaaactgagaggaactcctccactgtcccttctgcttactcagcagatgggagccagccactttgttttgtcctggggcctgtccttgatggcttctaagactaaaaatcaaagctgtaaatttgtgtaatttagagattgaaggtactgatcgttgttgtcagtgactggaaaccaggcctattgagcaagagccattgttcagtgcctgtcagcccagagagtgtgccgaatgcactggccatcttagacacagatctacttggtggtgttctgtgttttttctcctaaaagaaggcttctcacaccaccactgatgagaaaacaattcgaggaaaacgtaggcacactcagtacatgaagggagacactattaaaagcaaaaagagggttattgtcaaacttagaacgatgctaatttgagttctgagctctaaaactggtagaattcaaacattaaatgtagaatgtactagtattctatgccttaaacagttgaaaggaaaggcttacattggcaaaatgtatttcacaccaaataatgatcctaaatcagtcttttgcaacgtcataagatgcagctttgtaagtatactttatttctaaactttaccaatctcaaaggctacctggagctcttatttctgaaataatttcaagatgttcattctctacagttttgtggtatgattaacttcgaagtccactgcagacacaaatgaactttccctaaaatgcaacacgagagtactaactacagtcagtaaagatgagagggggttattttgtagctcttcctgcaggctgtgagaatttttttcgttaaaaaattcgttaaaaaagcaggatatactgcttcagtccttaccatgagagccactcccatcggaacataaattagtcttagtatatttcaggttctcccacatgttcacattccaactgggtgcaacagttgacttttgtctttaactttccttggcaaaccgatagcatcagaggaagagataagctgccccttagggagctgattgtaatgcgttccagacgtctgcacgcccctggtgcaagcaccagctttctgttaaagactcagggttatgttgtttggatgttttgttgtttgctttttgaaaaagccagatcagatttttgtcattgtataaactccagtaggagaagagggatgcgtttttaaggtgatttctagaatgctctggccgacttagctgcagaagaaaaaggagaaaggaagagacagtgtatattttggcactgaaacttctttagtaacaatgcattcattcacaaatctggagagaactgaatgtctgctttttaaagtctgaattgaattctcgactagactttgagaccctgagaaggttttcaatccaaaccatgcttaatattcacgttttatcattattgatggaaagtgaaagaaaatttgaattcttggtagccagatttgacattagacttttacatttataacctcacttaaactttacaagaaatctcattacaggtattattatccccatttttaaagcaaaaaaaaaaaaacactgacccttggaaagaagaactggcactattgagattcacaccacgtgtggctggctgcatcagggggctcataaagaattcagagctggcccccagcttatcttccccattccctcttctcacccccaagctacctccattaaaagagatgccaggctatatttattttattatgtatacttacgaatgcatttgctcatctttggtgtcataaaatacaatgaataaactcctatccagtttttcagtgtatttccttaatttttaaagcaataaactcctttaatcctcccttatactcaatactaaaaaatgaaagatctgattttaagcaggaaaagttttgtcttagcatatagccaggaaacttcatctgcctaggtcctgaaatgtaagtgatctgccagaaccaagcgtgggggtagctcgcgaggcctcagccctcctgctcctgtgtgagagtgctttcttctgcaacctggctcctggaaggaatgaatgctcccccttcagcccctactccccaccaagaatttaaaagataagagggaaacatttccctgactctaaaatggtttgtttttaatatggtatgtccaggcctgcactactaaaatccttcataaaagtcctctagaagataacgattgttcacattgcaaacctgtttgaaaagcctggaaaaaatgcggtatactgtagggaaagtcagtctccttttctcacttatataatttgtaagtctgtcatttcttttttttttttttttttttttttttttgagatggagttttgcttttgttgcccaggctggagtgcaatggtgcgatcttggctcaccacctccacctcccaggttcaagctattctcctgcctcagcctcctgagtagctaggattacaggcgtgcaccaccacacctggctaatttttttatttttagtggagacggggtttctccatgttggtaaggctggtcttgaattcctgacctcaggtgatccgcccgcctcggcctcccaaaatgctggaattacaggcatgagccaccgcgcccagcctaagtctgtcatttctaatatgctctcctagttttagctcagtagtagctgagtattatacaaaataagctctttttactgctgcttagcatgtgtctgcgaaccctagctcagtacctggcattccatgggcaggcaagaaaagtttgcagaatgaattaatctggcccaagtgtgactgagaggccagaggaggtcagtgggtgccgtctcccaggccagcagcacacacacagcttcctacagtctcccttcttgtctttgtctctttacatcctcttcccttcctcccatgtgtctctaacctgccaattgcaccaacatttattccctgctgcagagcctgtggacccacagtctggcttacctttattttctccatctccagaatatgtctctcctccatacccccataaattaaaagtgacttaaatatataaaatggaagagagaggcaggataaaactgtttgataacttaatagtacaactggccagtctctcgtagattttttgcattcattccaaacctgttttttgttttgttttgtttttgagacggagtctggctgtttcacccaggctggagtgcaatggcgcaatctcggctcactgcaacctctgcctcccgggttcaagcaattctcatgcttcggcctccctagtagttgggactacaggcgagcaccacctcgcccagctaatttttgtatttttaatagagacggggtttcaccatgctggccaggctggtctcgaactcctgacctcaagtgatccaccctccttggcctcccaaagtgctgggattacaggcataagccccacgcctggctgaaacctgtttctattaaaagacttataccttggaactttaataagtaatttattaaagaaccgttaatattagacattaaaataattatgactcccttacccctatttgataagcatataggtgacgttacactaaatactatccctgtctgccaaaataatctaatgttgaagcagtccaccgcatttcaggtctcctggaaatgtgctgcgattttctgaaaattagaggcaacaacttgctgttgaggacaggaaaaaaagaggaggctaagacgcaaggtcctctgaagcttctgccagctctctcaccagaacctaactcttgataccagtggagtgaatctggaagtctcctgccttcctgagtgagttggagacgtagacactacctggacaggctggagaaatgagggacttaaaacgtagcacaccccttgccccatgccacctgactagaaatgcctgccaaaggtatatggacatgcaaggctggcacagatgtaaagctcaatatattaaactagatagcaaagaaatatacaccaagcccagcaatacaaagcaccctgccttcatgcagttaaacattcttctgttttaggccacactgtacttgctggcttcatgtggcttcatgaaggcaagtgctgtgtctgttttgatcactactagatttctggcacccaacatgtagtaaaagctcaatcagtatttgttaaattcattgagagagctgggaaagaaggtagaatgaaaagaaaagaaaagaaacaaacaaaaacacaagcctgggcaacatagctagactatctctacaaaaattagccgggtgcagtaactcacacctgtagtgccagctactcgggaggctgaggcaggaggattgcttgagcccaggaagtcaaggctgcagtgagccgtgactatgccactgcacactccagcctgggcaacagagtgagaccctgtctcaaaaggaaagaaccatccacaaagttagtagtgcctacaagagtgtagttgctctttaagcttgaatttttggttattttgcaagaggtattatttgccttaagccatggtaattagatttattctgctttgtgggcttttagatgagttaatcggctacaatttctcttaattccctctaatgctttctaggtgtggatatcaagaaacctacatgttgtgtttagaatattttatgtatcacagatatcagtgggtagtagactttgcactggaattgcccttttccctgcctcagttgtttttggtaatattaactctttatttactgttaaactttacaaaaaatgtcaagtttactttttaggactaataaattagttttcataattttagccatttaggaaaaacagaagaaaccacattgcagtgtaaagggagaaaagtcacacatagctaattattgataggaaaatgagaagtgagatagcaacatctgagaggacttcatatatgagcatctcacagagtaactttttcttttagccagcataattactagcttttcccatgtgtgtacagacatttttttccttagaaattttggccttaaaagtcaaatacaggttgttttacagatgatcaatggtccttctagaagaagtccacagaagctctcagatgccctctagaccagcctttactcactcctctgtcagcatcctccctcccagctcgcattttaccaaagctagaaaagaccctcaagggcctgggtgcgtggaattattagagaccagataaaagacatgtaaggagtgctggtgtggcagatgctgcgaaaaaaatgtgccacaacctctgagggcaggaaactgaaagacctcgtgtggtttggaggcctgaggaaagagcctcaggaagtgatgtttgacctgacatctgaaggctaaatgggagacagagacaggtgtgcagtcaggaggaatcgcacattgaagggaagggctgagactctgagaatgggggtgggagggagaaaagaagaggctacagggggcgaccaggcctggtgggccaggtgaaggaatttggagttgatcccaagagcaagcgaaagtcactggggacagggaagtcaagagtcacaggattccatgtggtttttgaaactggctgcatggaagagaacagcgtgtgggagaagtgtaggagagggaaaggcaggactcatgatggttgagatgagacggatggagacaggcagctctgacttctgcggttctgacttgtgaaacaggatcagggatggtgccactgactaaagaggaagagaggattccagtaacaactaagcactattctcttttaatctctgcaacagccctactctgtgggttctattattaccccattacatagatgagaaaacagaggtacgaaagattaaatttgtctagagtctcctggtaagtgttcagtaaatgtttgctactactgcctctgtttactcatggagtcattcattcattcattcattcattcattcatggatggtatgctgtatctaagataatacattgttgaacagaatagatgtgaactctgctcttgagaaagactggtagtgggagaaaaagacaataaacaagcagttatcttgcttggacaagctggtcagggatggtaggacggtctaggtttcttagactggaatgttacaattctagctcttgcataaatcttggatggatatacagaggaaaaatacgtattgacaaagccaaaaaaatgtttcccagatgttctctgaggttccacaggcatccccaatgagttagatcagaagtaggccctgtgccgattttgtaggtgggaagctgaagatgcaagaagagaacagccgtgcagctgtgctgaggtctcaaagagcaagggttccaggtgccgccgctcctgctgtccagcaggttcagctgcctttgggcccaccaaggtaggaaatggcccatatctgactgcctctgtacaggtcaaatcacagctccctgttctctactatatatagtaacgaccttacataagagtgctattaaaaaaggacgacagagaggaaaagagaatgccagctgaattttttccactaaagctcatttttaacagatgtgttttctctgtttccacaatgacagtgtaccaggggactgttctccaggtcaggagggaagcaacccaggtacttgtaggactgtaattgggtccgtctgtgctgagcacaacaataaaattacttgtacttccctttttatttaatgttactctcctcatcagttcccattttcctgatatttgtgggaaggaggccatgaagaaggatgaaaacactgtaaaaataatttaaactaaactttacaatatatttgggataatgctgagaaggaatgttcttttttttttttttttttttgagacggagtctcactctgttgccaggctggagtgcagtggcgcgatcttggctcactgcaagctccgcctcccgggttcaagcgattctcctgcctcagcctccaaagtagctgggattacaggcacatgccatcacgcccagctaatttttgtatttttagtagagacaaggtttcaccatgttgaccaggatggtctcgatctcttgacctcgtgatccacccgcctcggcctcccagagtgctgggattacaggtgtgagccacctcgcccagcctgaaaaggaatgttctaagttcagcaaaatgagtgattaacatgtaagtggtacgtctatcttaaatgctttaaattataattcatgattttttaattaaggctttcttattccatctgatctcttatacactctagtacccagtgatacacaaattttgttaattttggtaagtcagtctgtctgtgcagtgtgtgaccttgacattatgtaatatgaatgggatggctacgtgttcccttttccccaggacagtcaatctgccagttgtctagagttctatatagttcagcctttgtcccagattaaagggcccacatttggacactgaattatttacatgaccgtcctgaatactaatagctcacatttatcaaaggcatgcttgaacattgctcaaaatacttcacatgtactaccacatttcatcttcacagtctaggagggaagtgctatcatgacccccattttatttattttagattcactggttacatgggcaggtttgttacaagggtatattcatgatgctaaggtttgggtttccattgatcctctcacccaggtggtgcacacagtacccaagaggatgtttttcagcccctccccacctccttctctccccacttttggagtacccagtgtctgtcgttcccatcttcatgtttgtgtgtacacagtgtttagctcccacttatcaggaggtatttggttttctgttcctgcattaatttgtttaggataatggcctcgagctgcatccatgttgctacaaaggacatgattttgctctttgttgtagctgtatagtattccatggtgtgtatgtaccacattgtctttatccaatccaccattgatggcatctaggttggttccacgtctttgctgttgtgaacagtgctatgaggagcaagtgtacatgtaccatgtggggttttttggtagaatgatttattttcctttaggtatatacccaatactgggattgctgagtctaatggtagttctatttttagaactttgagaaatttccaaactgctttccacagtggcctaatttacattcccaccaacaatgtataagcattcccttttctccacatcctggccagcagctgttgttttgacgttgtagtaatagccattctgactggtgtgagatggtatctcatcgtggttttggtttgcatttctctgatgattagtgatgctgagcattttttcatgtttgtcagctgcttttatatcttcctttgagaaatatatgacccccattttaaagatgaagaagcaggttcagaaaaattaagtgatcaaagaaactcagccagtaaataatagagtctaaaatttaaacacaggcagtctaactccagagcctacatggctaagaagtacagcattacctttcattcctaaaccagttaagaagtatatgaataaaactcctagaggatggaagggtcctttggaactgggaagttcttggagtccttgaatagaaatgctttcccaatttgccagtgcaggggccctttatgggaaacagtgaggaccatccaacagtccaattaactgagcacaaagcacaaggcatatttgtttttctttcttttgaaaacataaatgttagaaaagttcagaaatgaagagatttagaagtataaacttataactgttggaaccatcctcgtattttctagaccagtcttccttctctcgacaacccttctctcatggccattcctcgccctccatgttttcatgaacagtgtgattgactactctgattttgttagctagccaaagtggaaaatgagaactcggtgagtgggctggtgtatgctgcctgccagaggcagcgctctgtaagacgacttcattgtttgcttaccctaatgctccattacatctcaggatttatttataaattatttgttttaggatatggtactagcttcatgaaccccattgtagacttcacatttagaagtgttttttccaactcttttttacttaattttcatgagaatagtccttacgtcaagatgaaagaaaggtgaaacaccaggtagaatcagcaaactgataagcagccctgtttaaatccatggaaaggtaatgtttaaagaagacatttgttttaattgatttttattttacgtgtacacattaacttcataaatcttacctttcataccaagaagcctagatcagctagcgtgttaatatgctgacggctgagagcaaaaatagataacctaaagttgtctaacaaattagacatcacttaagaggaaactcaagtgtgtttcagggagcagtggcagatctgccttagatttttaaccactgcatcatcctgttaatcaagatcaatcagatacaaaaatctttggtcagaaccagtattacaaaagaacctaagaatttctgctttctcatctttctgtttaccataacacaggcatatatccaaaaatatatagaaagcaaaaatttggagagaatgacatgcgctttcctaaatgcaccttaatgctttccctggtgttactattactactgttggaagcatcactgttgaaatgagcctgtacgtcacacacattgctccccacacagcaacacttctgatgagggcagccccctgccttgttattcattgagaaatagaaactctgattatttagagcaaaatttcagatttgaagaagttttcctaataaggaagaatgatgtaattttcatggaggggggccaggttcccttcatttgttttatttatattagctgaattccaggggaaaatgggctatgaagcatgagggctgctaactatatttagccacacaaagttagtacatcaggggtcattttttctttaagttatacactcataaatgggctggaagatatttttcccggcatcttgtttttataaagtttgatcaagcataaatacttttattaagatgctatcttttatttcgagtgtgaagaaagtatccattgtaatctctttaatttggcatgtttctctgagatactggtttttgggtcaaaagatggataactaataacaataccttggttcagaagattgtattaactttccagagtgctcacgcctgtcatcccagcactttgggaggccaactcaggagaattgcttgagcttaggaattggagaccagcttgggcaacacagggagaccccatctctacaaaagtaaaaaaattagctgggcacggtggcacatacctgcggttccagctacttgggaggctaaggtggaaggatcacttgggcctgggaggtcgaggctgcagtgagccgtgatagtgccaccgcactccaaccagggcaacagaatgagacccagtctcaaaaaaaataaaaattaaaaaaaaaaatccagagtgggctttaagaaggaagcaatagtagtttcttggaagaaagataatgtgtgtttaagagtcccgttctgcccattgtctggcactattcaatctggattcactcccatccccctcaccttactctaaatataaaaatagtcggtgcgtcttaagacagtagactatcatttttgtacttttgcattaagacttttatttaaatgtatttataaactggagaaaaatttgtagcatttaaacataaaacctcagcgttataattggtcattccttcctcttgtcaacgtgttacaacatttttgctttgctctgttacatgactcggggcttacctgcatttcacgtgagagaaaagtcaaattcatctccaccccacagcctgctatcttctgccttttaccctaaatctttggaggcgacagcttcctccccatgactgatagttatccatgctcacagctgctggcaggactgactcctttacaactgtggccttgtagttgatctgaacaggatgatcctgtctatggaagcggagtcttctctcactgcctgaaggagaaggctctgctggagatggagggctctcatctgtcaatgggtagcaccgacggtgccccagacatgctgaccatgtgtggatgtcttagaagagtggaaaggcttgagaaatgcaagcttagaatcatttctaatattacttgatgggaagtcagcaaataggaaacttgtaaaaaattggaggacaactttttgccactatcatggacaaatctatcaccactaccccaaatatcggtccctcagagaccaagtccttagattctgaggctctgctgtataattcctgttcagtagagcatctggcgaacctctagtaggacaaacagacagtaacccttgtgagaagtgagggaacttttagaactaggcctcaaggagcactgtacagtagaaacagaatgtgaaccaccacaatgaagaccacatatgcagtttgttttctagtagtcacattaaaaaggaaaaagaaattaattttaatagtacatgttgtttaacccaatatattcaaaatattattttaacatgtaaataatataaaaattgtcataagatcattttccaatatctttttaaactaaattttttaaatctgctgtgtacttgacacttacaacacgtctcaattctgactaaccactgttcaagcacttaatagctacatgtggctaatggctaccatagtgggacagtgcaggtctggaggatgtgaaatcgggtgaacacacaacctttacacccgaaacagtgctgcagaattgatgataattactctaaatgctcatctcttatcttttcgcgtctgaaaactgctgctgagtgtacaaaccaggtaacagtaataagggccaatcccagtggtagaaatggagttgatatggtggagaaggatctgttgacaccagaccctcaaccacagccatgcacagctggacagaagccccctcggactcccaggtctggagtcggggcagaggcagaaagtctaaaaagaaatacatcagtgtagtcatttcagtaataaatgctgtgaagtaaataaaacaagatagtaaaagagagatgggagtactcttcttgctcactccaatagttgagtgagtcatctgggaagtaagttgtgctgtggagtgtgaaaggtgattttaattcagcctgagagccaggcgcagtggctactgcctgtaatcctgcactctgggaggccgaggtgggcagatcacttgaagtcaggagtttgaggccagcctggccaacatggtgaaaccctgtctctactaaaatacaaaaattatctgtgcctggtggtgcacgtctgtaatcccggttatttgggaggctgaggcacaagaatcacttgaacccaggaggcggaggttgcagtgagctgagatcgtgccactgcactccagtctgggatgacagagtctcaaaaaacaaaaaattcagcctgaggaaaatacttcctctagtcctcaacgtgactaaagagatcctcatttttctttaagagagaatttcattatttgaaaacacaatgcccaaagaaatggaagaaattgaagaagctggtttctatgtacttcaaataatattttggtgtgaggccccacatgacaacatctttcccccaggataccacagctgacatagctaaaatatgaagtatggcctaaataatacacagtgagctgataacttaggaaatattttttgtttgttttagccaaggcaaacgaattaaaaattttaatgttttgtttccatatttgcttaagtaaacttcaaaactaattacttgcaaagaattttgcctcggctacatggatgaccagtgaatgcttttgggagtgtaggactacactgaataatcgaataaatctattgaatatggaattaaaaaaaaaaaactaagtaaaaaagcattagaaccaccatacagcttatatctatatgcttattatgtatgggctggcttaggagggaacttgagaaatggtaacagtatttggttgatgctggagagggaaattggactgggaagaaaaagtaagagatgaagatgtactttcagtgttctctttatatcttttgcattttgaagagcagaggtttttaattttgatgaagtcccagttcatcaattttttttctcttatggatcacccttttgttgtcttatctaagaaatctttacctaacttatggtcacaaagattttctcctatgattccttcttgaaatgttatagttttagattcacatttatgttgaagattttttttaatttttttttatttttttagagatggggtctcgctctgtcccccaggctagagtgttgtggctgcaagatcatgacctcctgagcccagttgatcctcccatctcagcctcccgagtagctgggactacaggcatgcatcaccatgcccagctaattttttagttttctgtagagacagggtctcactttgttgccaatgctggtctcaaccttctggactcaagtgatcctcccccttcggcctcccaaagtgctgggattacaggcatgagccaccatccctggcctgttgaagactgatattagttaacttttgtataaggtatcagttgtgagctgaggttggaaatccaatagggtttggaggggttttttgtttgtatttaatcatgtgtattctttaaaaaataggatttaatttcaagagattaaaaagaaatattgtatagaaatgtctgcagttataataagtagttcaattttaaaaagaaaaagttgttttgtttgctttgttttgagacaggatcttgttctgtcatccagtctggagtgtagtggcatgatcatggctccctgcagccttgttctcctgggctcaagcaagtagctgggactacagactcacaccatcacacctggctaatttttttttttattttagcatagacgaggtttcactgtgttgcctaggctggtctcaagatctgggctcaagtgatcctcccacctcaacctcccaaagtgctgagattacaggcatgcaacactgtgcccagccaagaaaaaagttttattatgactactgtactgattttcaggaacagtcattgtgctttaattctctaagccaaaaatgtccaattctgttgggcaaaaagactatgttgttgattgcgctctctcatatggtcccttgccttcagccattttcataatcaaaacttgatggcagtattttgttacagggtaagaaactaaaaatggtaaaagccatttgtcagggtaaatctgaactaattatttagatcagctgaaataaaaagggttacaaagacaagttttctgtcttcaggaggggatgtggatactaaaacttcaatggaaatgaaaagatatggataaatttgcatctgccagatctgcttagggaaagcatatacatgaagtggaggaagtcttcccatatcccttacataaggattgagatctgctgccagagacacatgttgcaatatcaatagaaggtcgtcaaattgccttccatgagggagtgggtctgtttaatgctatcattttgtgacattgagaacacgtgaggccacccacaccttctctgcccttcaccagagctggggccagcctcttccgataaatgctaaataatgactatcgctttgaaggtgcacttattagcaagggagtccatgtgtctagggttcttttacgccattacagtgtatgaataatgtacatttgacgggggatgatcctctcaccctactcaagtttggaaccatttgacagataaactgaggagtcagaaagagatccaagcaccagatttgtactggggagaactcagagaagaaaggggatgcactgctgggcctcatgagttggcttatacttcaccttgagctaagcatactaatacccagtccaggcagcattgaacagctccgcgcagatctcaccctccaaaaaacaggaagaaaaagccctctcactgcaagcaagatccaaagagagaagagcaagggaggggctgatgtgagcatgcccagatccatcccccacccatattcgccaccaagggcggagacaggcaaagagggcccctgtcctggaaatccctccatgaggaagcagtgaaggatgcagggcccactctgtcagtgtctagtgttccactgatcctacatagtaattttgaaagacgatagcatgatgttcctgaaaggaaaaaaaaagtttcctctatgaggtcattaacatatatcttgagtgactttattgtcttctggttcattttgacatttttgtaaattctatagatcttttatttactcctgtgatatattttaaagatcaacaaatgtccacaccaaagaaaaaaatcaccagtaagttcgtaacttttatatttctatacttttaactgttacattaatcctgtcttattcaaaaggtattcaccacaaaaatacttactaatcttggtttcctggtatgaactccttgtgcttctgagattagagatacgcttttctttacgggtggccacaatcaagagataagatcatgcctaaaaggacaagttaggaacagaagtgtgattaagtatattctgtattagttttaattaggactatagtcctttaacaatttcatcatatttaagcttgaaaatatacatgattgctgataccactatagtcatatacatgtatatatgcacacatacacatgagagatgagactgtgttactcagacatagaaccacgggacagtcagctacacattacttctaggcaatggttcatcttctctcttcagggaaaaagtaacccttgttggaacctgacagattttgaacatatcttttctttgttctttgtaatgtttatctgtattcttgttagaaacgactttctggttcagttatttaaaagattaagccttttagtgaaagaagttctcaccttggtgtcatcacttgagaggctaagagtgaagcaacctagttactactctgggctctgttggtggcctcctgtgtggcactgcaccaaacgtacttattactcagctggatgagatgatcccggttccttccatccacatgttccatgctttcctgtgtatctcggcgcacagatactatacatacttcagtggctttttccgttgtttaaatcttaaaaagaaaaggcatattctggtgtatatactacttccctaaatgaagggccatctactatataagtcttacagtataatcatgaaatccagatgtggtgtgcaacaaacttcattatttacatgttttggaaaagattaataaagtacagcaaaataagctcaatactacagctgtacacactatactataaagtattcttcttttgaaaagcatttcaagattttgcagcatttttattgtattggaaacagtcacagataccatattatagaaaactctgtttgacagaacgccagatgaataactgttgactatacacagtcatatataaccacattggaaacttcatgtagctatgataaatttctctcattttttccttaggagtaattacattagataattgaactgtttcatctaagaatttattttcgtggttttagtcatttctcagggagggagcctcatttattacagttctccccaagacacactggatagacttcatccactgctggaaggactggtgctgccccctgaggggaaatggctaggcagcactgtcttcactgcatcttatcctttggcctctaaggaatgtcaaggtcagctggtcaaaagctaagaagggccaaagccatttaaaatttacagttcttttccacggtcacaagtctcttaattcatgctgctaggctgcatctcttgtgcttgccaaaacgcatttttgagctttttcaagaactttctccttcttcagaggagaggttgggaagggagtctggtgatcaggcaagccctgcattcacaccacggaccctttggcttgtatatcttggccattagcatttaaactatcaatggtagacttgtaagaggaaataaattgctctgagtatccagatccaactgtgcattcctcacattgattgcaagaccaaaatatgtagaaaatgttattggcaacattatttattcaaaaatgtttagttcttcagttataggcctatgttaatagaaatttgaaaagtcgtctttatagtgttgttcaccatatgatataatgtttctaaattgtatcacatttagtgatacagtatctcaagagatggaacagcataacagatgagtaatattagtgatattcagatgttcaaatgtacaatcttgaaagactaaagaatgaatttattagcatgggcacattttaaaaatatttaaaggggactatttaaaaataatcctactatactgcaaagatatgaaagaaagaccgagaatgatttagtgaaggccacacagaaaattggtggcacagtcacttctacccgggaaagtactaagtagcccagtggcagcagatgctaaaaaagggctgtcggtgatttaaaaacaaagctatttaggccatgtgtggtggctcacacctgtaatcccagcacttggggaggccaaggtgggaggactgcttgagcctgggcaacatagtaagaccctgtctctactaaaaaaaaaaaaaaaattccactgggtgtggtggcacacaccagtagttccagctgctcatgaggctgaggcagaaggatcagttgagcccaggagtttgaggctgcagtgagccaagatgacaccactttactccagcctgggtgacagagcaagaccctgtgtcattcatgaacaaacacataagtaaataccaaactatttttaagaattcaaatccaattattttggaaatgattctttttgtatttatttttttctaccacaaacgtgttcaaaaaagagagtgaaggacagaaccataagtatgtaggaacttccataccatgaaattctatggtagtatttattgcccttatgtgatatatgtctcttgatttttctcagaaatttgaattaatactatacttggaaaatgtgaagtaagaacctttatcaattggtttcatcttcctgttcacattttggatatacaatatttagctgtaaacacatgatgtttgtttagtagagaccaaccattcattagtttctcaatataatgaacgctagttgatggtacttacactgaagtaagaaattctggaagcaaatttaatttcttagtttcaaagtcagctcctccaggttgctttgtacattcttatagtttttccaagaaatgtttttaagtctagcatatgagacataactacctaacattatatgcatggaatgtgttcaggacatagcccagctgtctctatagctgttttgggtgccattgcaatatctgtatctcaataacaaagaaatagggcataggaggggcagacttagagccatagtcttgagtggagcccaaatcagaaaggtcctctgtgtctgaggaagtcgcattgcacatggtaaatataagataagtcgtggtgctttggttagagacatggtaacgtcatggtcatgagccagagctcctcagtttaaatcccgtctccacttctttccagctgcataatcttggacaacttactatatatctttgtgcctcaatttcttcatctgtaaaatggagataataaaagtggcctctctcctcgggtttttgtaaaaattaaatgagtttagagggaaaagtgcttaaaatggtgtttggtacatagtaagtgctctatagcagttagctctcatcactagatgtggtgacgctgttggtgctggcagtagtagtagcaatagtcatgcttgatgaaattatttggaaaaggcctcccctggtggctttaaacacaggaaatggatgaatggatacccttctcaggcctccaggatattttgttactgtctaaggcctccttttaagttacaaacttatggagttttatgttttaagagtctttttaaccactatactttttatatgcacatagttaaaaacagtcaaatagtatagaagagtataaaatgcaaaaataaaagatgtcccccctccacctcattctagtcttactttccagaggtgaacactttagactatttgtttttagcccttctggtggtttctttcacaagtttatgaacaatatatgaattcatccatttattgattcatcaactgccgatagtgctattagattaatttttatattgttcgtaccagcaagatgttcttgttgggcctttggtaccaaccagctgataacagcaatttcttgatctccctgtgtctccatctacatatcataaaataaggatattggacttgttggtttccaaggccactttctaaaaagtgttaagagaccatttgaactaatttaagtgaagagaaaaaaaaaaaaagaaaaaaaaaattctgagataaaactggtctgagggttatctggatccagcggctaaaatagtattccaattttaactgcgtctctccctttttcttttatataaggaattggctgctttttatgtactggcttcctttttgtagacccttccatgatggccaggaactctaggtgattctatgcttctagacacatttcccttccatcttcagtacgaaaagtcccagggaaaggccctgcttggcctggcctgacctggattatatacttatccttggataatttgctgaagccatataccagttgactagtcctggatcacatgctcaccctgcaaccaagggcaagaggattgtgactggcagacccacaaggaatagggtagaagcgtatctgtaaagggagggaggagtgctattaccagatgaaagaagaatggtagagaataaaaacagatgtctgccacacttggagtttcaggaaattgactttaagaagaaactcattcaattctccacctactagtgagtcattacttgcttgtaagaatgcttactgccacacattcaaccattggcctcattctccttccagaaataaagcatgaactccacctacacattctttaacttagtatcagccataagcgattcctggcagtacttcacaacacttgaaaaatgaatacagacatcagtgtgatgttccaggcagacatcagtgctttagcttctagcctcaacacaggcactcaatgcggccttgttagaaacactctgtccggtcttttatgacttgctacactacacaatggacacacaagggaactgtttcctctctctgtatagggaccaactttgttatctcaggatacagtctatgttttgaaaaagtggctgtagaacagtgcagggatgggaagaatgggtcctatcaaagaaaagaactgcctagagatgactgaagttctcaccaagtactgaaaatatccccaaggcacttctcttcaaggtaaacataaacttattgcgtttttgactgataaccaaatcaaatggaaaatgggcactggtacaggctgccactgcctggaacatgatggagcgcctcacagatgccagattaggagctgcattaccaggttcacaaacgttctcattcgggtttgggagtttcacattttggatactaacaagccagaaatatataagtactgttacttataagagctctgatacatatatatctcctttattagaagatgcgtttccctttcctgtattccacacaaaaggatgcctggcaatcttttgacaggtagtaagtgacatctatgtgcaaaacactgtaataatcaagaagatagaacacatctggctctgggcgatctgggctggtgtgtgagatgataatgccactgccaaactgacagtgccatgccagccttgtgggctggagtagtatggaggagggagtaagaactgctagatgttactagggagagcttcaagaagaaatgggcattgaaatgggcacagaaggatgaagacagtggatggagagaagttggtgggggtggccctccaaaagagagcagtgcatgagaagaggccaacaggaaggaaaactcaaaatgggtttggggaacaataagagtaacaaacttagaagaatgaaaaggtagagatacagcagcattagttggagataagattgttaggactgtttgaggccaaattatgggtatcttaaatatcagatattattttagggagacaagttagatcagggtgagaggagctctgtctagacataagtttgaagtgaagtagcacatttatgttacatggaagtggatagtggaattcaggactgagggctgggttagagagatcagggagtgagagtgatgcagctgactgactccttgtgcaaagaggagtgtaaagtttagatcttggtaaggtacccatatttagagagatggagaaccagtgaaggaagtaaggcacagtcccagaagtaagagaacaaggagagttgttagtgatgtcaagggagaagagtgcttcaagaaagatggagtgggtgagcccactgtcagaggctgcagagataccaagaatgaaggcagagaaaagccatgggactgctgagcatagcacaaccctatcttcatatttgaatgaaatgtcaaagccaaaacatccaaaagagtagtggcagaaagaggggaaagggttattaacagaaccttggccacttaccactgaaatagtttccatgtttcctttaagggaaagcattatagcagaaccacatccaactctagccccatagaaactattttgagacacacaaaacctaaaagctatttttgtcttgatctgggtagaatttatctataggtatatctgtcttaagaaaaaaatgcaattgacgttagctagttagttgacagaatattcacagaacagattattcacagaatattcttccttttgtaagatttaccatggaattgtttttatctgcctctcgaatgcctttaaaatcttcttctgttttccaaaaactgatatatacgtttttcaaaaacagtttaaataggtgtgaaaacagcatatgcataaggttaatatatgcacacacacaaataagtaccatacttggacttgtttagttgtccaagtttaccagtgtctttgaaatcaggttctttataatatttaaatcttacagggctaaagaggacaggtcataaaatctaaaagtttattaggaccttaaagttgaaaaactaccccagaaaggataaataaaatatccaaagtcataaacagaacgtggcagagcaggagccacactatttgaacgtttctctactgggctgactccatgtttttacttgtaaataacctgcatgatagtggctttatttctaagaatactctcttaggaaaatgcaattgtgtgttgctgaatgccatagagcttgatggaacagggagttttacattgtatagaaatctagggatttgacttcaacagatatttattgagtggcttccctgtgagtaaagaggaagatactgaaaatggagggctcagcgaagtgggaggattgctactttttgtaaagccatttggggagtagataatggttatttgtttggaaagagatgacactctgcccttagtagtaatcgactcttataaatactgactgcataccactgttttggatgtattcaacccagcaagcataagctatgatgggactgacacaagggatggcaccagccattgtgtgatgaatgaaaatgaaaagttggggaaacattaaccatatgaaaccttaaaatatgccaaattcgtcatttcattggaagacagaaagtgaaatatctgtctgtcctttcttccctaattcttcaaaatctcagagaaattttatacttaagaccttaaagtttctcaacatctgtctcacagggagcttttccttggtgtttcaattagaaatgagatcactgattttgcttcaagcattgaaaaaaaaaaggttgaaaaacagattttttcttcaaaaatgtactttgtctatgttaagaattgaaaccaaacattttctattaggaacagtcggtattaattcattttaatgtccactaaattagcatagtttttataagaatcaactaatatcttcctgctgttttcactggccttcgcatcagtagaaatgaaaatcattttgggcatttaactgtgatgcagagtcaactcttttagaagctgacttcggattcctcccccaaaaagaggctgggactgaagcgccagcattctgtgttagattcctcaggcacatcacaactgcaggcactggcaaagcctgtcccttatcatatgcaatttatgtcaggctacaaatcctgctcttctggtggggctataaattctttggaccacatcctgcagccctctcagagccaaagtgaccatttaccccacagagagttggatctccacagacctcctagatgagacatctcaacatctggaagccagcggcaggagtcaacttatgagaaacagttcacattgctactgacccttgaagagcaccatctcccctacctctcattcctattcttcatgttacatgagagactcagccatcctttgatattccagagaagttcccaggaggattaggaattggtcatcagttgctccttctctctctctctatcggtacgtggaatgacttcaaatagagatcaactttatgcattaagacatacaaagctactgtttttctgtggcagagccaaatatggctcttattctaagtacaaaggaaaagtctctctaaaagagactcaagtcatgtgctgatttcactcaggtcacttctcccttgagccctcctccataattgtgttcagttctggctttgtttggaaagtcagcacaatttacaaaaggttcagaatgcattaaaggtcaaaaaatagggctttgtaaagaaacctatgtccttttgcaatacattttaaacttatacataatcccaagcagtaatcaattttaattctagcatttttttgtttatggtactttgtagaaaatccagatttttatccctgccttctcccccaaccttaggggaatgtatttgaattatttttgcactcacaacctcccataagcccagtgcaatacattctcatttgtcttttattaatccttactgtgtaaataaatgatcattcttaagattgggatttatataccttttcctaaggggcaatcataagttagtgctaaacaaatcaagttgttagatattgaccttcatgcagtggacctagcttctgtgatatgaagatatcaattgagctctgagtaatagaattttaaaagacaattgaagcattactataataaagttatagatggaactgaatcggtactacctgagtgggaagcccttgtaggagttttattttctattttatacattcccagaattgatacattgaagtctcatgcatatgatactgagctaatcttagccagatgggaatatattgtggaaacacctagcagcttacccctaattcacttacctaccttcatttgaaaattcttaagatttcccagtccaatatgggaccctcctagtataggaatgtcctactgaatatgcctgatgaacccaatggggtacagaattgcagtaagaaatttatatcattgttgtcattgacagtgatgagtccaccatgtttagtgtttggccaggtgctgtgaggatgccgaaagttaccctccttacttttaaagtgcttataaatatcaggaccagaggagcttatggttcagagggtgcagtcttgcaactcttcatacaatggcttctgtcatacaatcaaatattaaagaaagcatataaaccaacagcatatttattcatagatcacaaatgtttttcagctttgtgatctcaagagtttttctagacaattacgaataccccatctttattatgagcaggggataaattacttgcaatccagatattgctccagagagacatatcaggaatttccaatttacataaaagttgttttccagaagtttactttcacatcatttattttaaacttgggttgcagtttcccagagaaaaagtggtatgtagtaataatagccaacattttaacaaacgttttttgtttactgagcactctatagagaatgatgtggcaccaggctttctgagccagccagcacttcacatccaggttctgcccttggacacattacttgacctcactaactgatggtgaattttttaaatggggataaccatccctgcctcctagggttggtgtgtgtctccagtgctaggcacgtgataagtgccctatggcttcgtgatgaggagaaggcggaggagcagtgctaaaaccagccatcttagctggtctcatgacagccccatctccagttccccatttgcccacctgccactgctgttcccctgccagccacttgcaatggacataggtgaagagaaacatcccctgcaataagtaaaacattgttcttgttttaaaagttctggtttgtaaagtaaccagaattgatttgattttattctgctatgaaagataatttattgagctcatactctgaaccaggcactgtgcccatttaattctcacaatgaccccacaagctagtagccggctgagctggggttccaagccagttcgatctaactgtgactctagccctttttgtcatgtaccattctgccacttgggacagtgtttttagtgtggttaactttttctgaacttgctttaatctagtggtaggagagatgactgaattagaaaataaattaggtcatacacctctccttatctctgtcaaatctaaatctttgccccatccaaccatctgtaaaattattcttgttgaaagctttctgcaaaccactggggtagaggagttattttctataatgtatgaggggaatctattgagttagcatgaaatcaagtttgaagtcagatattcttaaatatattcttaaatatgtatttaaaaccttaactgatgattcagatcctaaaggccctggatgttacagctgcagtaaggtataaaagtgaataaagtcctcagaaggaaaatatagccacagatttttttttttaagtcacattgaaggtcagggtccttttatgtgttacatgcctgaagtagtgtaaagagcagggacagacacaggttctaacctggctctgcaggtaacttgctctgtggccttgagtgttacttaaaaccagtcttcccatgtgtaagtggactgtgccaggtctagacggtcccctttccttcagtatcaaaacttttagaattgaaggatgggcaagagtggggaatcgcttagattttttgaattaggggtatggaggagagcggggaaaaaagaagctgggagaaatttgatggattacttgtgtaagaccaaagatttaaacacatgacactcaaagtacatttgcaactagggctatctagaacgcttaacttgtcatactatttggaaatacatagtatttccaaaatactatggaaatacatactatttggaaatacatagtatttccaaaatactatggaaatacatactagttggaaatacatagtatttccaaaaagttcagtttcatgttttcagagaaaagacagcagaaaaaaaaacggagaaactaaagaagtaatgaatttcttatgacaaataacttctaagtaatttccaaaagctataggcaaccttgcctttctggtacctttcattctttcggcctttttatctctgtgaaaatcaacttttctaaaaatagcttaatgaggaagaagaaaatggtaaaattgtgcatttcatcacatcacagtccagatatgaaatccatttaactcaagtatttaaaagattatcatttgcacagaaataaagtcagacactttaaaattcgaaataaatgtttttgcgctccttttccccacccctccagtccctgcatattatattcttgatgcctcactgaaccacttaaaaatggtgaagtcaaaacgctagtaaagttcttcactacagtatatactagcagccaaatcactagaatgcccattcatttcttgtgaaatgctacgttaataatttcttaaactgtcacttcatactaaagttagcgcttccacagctttaagcccacttgggttagcaaacatgatggttctttttaatgcccgaatgaataagctgacccatggagaagttgagaaccaatatagtcctggtctgggctttcctgccctggtttctgtgaatactggctctcaagagtcactccctaattctggggccagggaatcctcacatcaggtacagagcgtgatatgatgtctgtagctacttcagcagagccaccacacacagcaatttgctgatgccaggccaagccttaaatacttaaaacacagctgtggctttggccattgtgagcccaggtggggacagagtaggggagcagcgcctttgaggagagccacacagatggcttctaatccagatgcagaggtcagctgaagggtgtggaagagtgttgataaacatcctgggactgggatgcatgctgccctattgaggaaatgtaagagagacagcaaaggcagggagatgaagcatttggggactcggaatggagagtgctggataatggattttagagctagtgggtggtttttatgagttctattcctgggccagttctaaatgcatgaatgccagagcacatgtgctggacagtctacccaaaccacacagacatctggaacttcagggcagtggtgaatcccagcagtgacatgcctacttttaaaacactcaagttcaataggaccccacaaagttctttgctgttcaagtatttgatgctctgtacatattaagaacatagaaccatctcctcattacacctttcagttcccaagaaagtgtgtctttgtcttctcatggacttaagtgtaatcactttactggataattatagaagggaacagaagacacaggacagagtttagaacttgctgatgttcccacagctcatgatacttgagaaaagacctagatattttttcactttttattggccacttcaattctttgtattgctgagtctctgaaggcttgatttttgcctatggataagaaagttttggggtctgatttttagttttaaaacgtttattgtctattcatagataacttgttttatctgcttgttacagtgccgccttctgttgaagtttcttttgacagctattggtccctatgtttacctcatgtgaataaaggaaaacatcctggatgtacagcaaagtttttgagtaaaagagtgagatattagatcattgctagctgcttactcttatttcagaaataaaaatttgaactatctcttctcaatggtaaatatttggggaattaaatatacatcattacaaaatttttgctattgtttattgaacacctacctgttatagaagtcacttgtttacatgtgtttgaaataacatacaatatcaatgtgtattaaggtttgtgtaagaaattcgcaattcagtttactactaaaattttgcataaagactttcttaggggacaaatgtagagattaaagtaaattttttaaaaaatccacctgtggtatttattgaatgtagagttgacagcactgaaataggcaaattggactaacgtaaatctgccaaatataacttcaaccaagtgtttttttgcttttaactttctcatttgatagaattcttttaccaaaaattggctacgaatgagaggactgagaattgatgtcgaaacgtttttctcttaatatttcttgatccgttaaaaacaaattatggctcctggaagtcagacaaaatttccatcaggatttgtaaactggttgggatcaccttatgtgaaacttaaatgagagtgaaatgggcgagcatacttcactgacttagcgcttggtccagaatgaactgctggccccacacttgggcctgctaacgtgtgcccgttccctgggtgttctctgcagctggcctaagtgccaagcgatgtccacaagctgagctcactcctggaatacacgttcctggccgttccatctctgaaggtgtcacttctctttttccccccagggaccctctgaagctccagcaactccagaaccaaatccgactggagcaggaggccggcgctcggcagcctccgccagccccgcgcagcgcgccgccctcgccccccttcccgccgccgcccgccttccccgagctcgcggcctgcacgccgcccgcgtccccggagcccatgagcgcgctggcctcccgctccgcccccgccatgcagtcctccggctccttcaactacgcgcgccccaagcagttcatcgccgcgcagaacctcgggcccgcgtcgggccacggcacgccggcctccagccccagctcgtccagcctcccgtcgcccatgtccccgacgccgaggcagttcggccgcgcccccgtgccgcccttcgcgcagcccttcggcgctgagcccgaggccccgtggggctcctcctcgccgtcgcccccgcccccgccacccccggtcttcagccccacggctgccttcccggtgcccgacgtgttcccactgccgccgccaccaccgccgctcccgagcccgggacaggcgtcccactgctcgtcgcctgccacccgcttcggccacagccagacgcccgcggccttcctcagcgctctgctgccctcgcagccgccgccggcggccgtcaacgccctggggctgcccaagggtgtcacccccgcgtgagtaaccgccgcggtcctccacttccctgcccctccgcctcgggtcgccctgggactcccacatctccatacacgcgctcccatcagcctgcaacccagagcgccccagtaacatttcacacatttctctccgtgcgatgtaaaaattcttaacggcaatttgactcagtgattcttgcgtagccacttaacattatcaaaatcagaactttttcctctgaattaatatgagattctcatcaggaactattcaaaatctatgcagtgccctctcttaatcattatgggggggggggtgcttagctatcatttattgagcactgtgctaagcaactcacatgtattatttcatttgatacaacattcctaagaggtagcattgccccagttaaagtactgaggagtctaggagttaaataaattgcccagggtcacatagccactaaaccgagacacgaatccatgctctcaccaccaaactatgtgttttattataatatttcatgccagcattacaatggatgtgaaggagtttggttattaagtatatacttagtgtttttgaaaaaccttaattaacagatttaagaaataagcctttgtgtaaatctagtgattgactggaagggggcaaaagcatgtaaatgtctttatgttttgatgtagataaatgagggtgtatgcaacctagtggagaaattatgatgccagttttgtccctggcctgtgacctcgagatacattacatgcctcctctatctctttctgtttgcaggtgatctaatatgtctctctttacatcacagtgatgatgtggcagccctatgaggtctttaaaatggaaaatctttgaggataaataacacctacagaagtacagtaaaatcctcaaaaaaatacagtacaggtgttaggcatgtttggttgaagagtaaaatgagtaaatgctagtacttactcattttactgaagatttcaaaaatgaggaagtgctcacaaaggttaagccagcacccatatctcaactcttccttctgaaatcctacttcagagtttgccagaagcatactattgttcagagagaaaaagaaggaactctactaaacagtaaaaaggagaagatcttagaattcaagttattttcattcatctataaaagtgttccattgctaggatacactaatgccaccttaaaggcaagcattgctatgtcgggcctcgacaaaggtgtaccaggcagcttcagttagcaatgcttcttttgttgggcacttcctaaatgttgattacattaatttgaaatgtggcttcttctcaaatccttattgggtgaaacacagtccaatgaatatataaagaaacaagtccaaaaaaggagccaaatatagtaatgatgtgataatggacttctgttgaaagttgtcagtcaacttgtctgaggagaacctttgtccttctcccttgttttttctctttgagcttttatttagctgttagaaaaggaagtgtattatcttggtacaaagaagctgttagagagacccaaagagccagagtttgttgcatgacactttttcatcctctctcattaaaagggtaccaagtcttgcttcccaggaagaggagtactgtgtaaataatctgttctaatatttctcttatagaatttgatcaaagattcgtttttcaaaggtggtgatgattgtgccatttatcatttgtagtagaaacagcagtttgtgctgatcagtgactttgaaaccttcttaagataagcaagttttaatggcttacctcaagtaacaggagcacttgcttcttgtcagcatctatcacagtgactcattttatggagtcaaaatagcttataattgttaccacaagagtccagtcgttcctgccatttcttaaaaattaatggagaagtcgtgccgattttgtggccatggaaaactgtacccaaagatagtgaagtgctgtgacatcaaagtggcaataccagactacagatttttagctccatgcctgctcagtaagccattattatgtggttaccgttttgtcctcaaggaattttcctgttgctaaatcacgcatacttgaagaattcattattttggtttgataaatgtgtcttttgaaacatgtttttcctctggcatactatgggatctgtcatttgcattctgaattaaaaacaaaaatgttactatttttgtttaccataataatccaaataatttgccaaagattgagtgtccctatcagggctgccatgactttggcatcctggaacttgcaggaactgccaagttatcataagatgtatatattcagtttcacttataagtgttatttctttagctggatagttttgccatatatatcaagtaccaacaaattggttgattatatgtaacacaatgaagtagaaattcattaggtttttttcacttgccttgttttaccaaaatcttaaatgtaaatttccaatatcttagttttcttttcttttcttttctttttttctgagacagtcttgttctgttgtccaggctggaatgcagtggtgcaattgcagctcactgccacctccgcctctgggttccaacaattcatgcctcagccacctaaatagctgggattacaggtgtgggccatcacgtccgtctagtttttgtatttttagtagagatggggtttcaccatgatggccaggctggtttcaaacttctgacctcaggtgatccgcctgccttggcctctcaaagtgctgggattacaggcctgagccactgtgtccagtctctcttagtttgcttaatcatacttgtatacttgctgttttattctgtttgtttcacactgttcttattttcatctgtagacaggaaggttagtaagtactaagtttctaaacagtctgtggagataaggttctgtttttcatatgtttgggtagcagaggtcaaagcagggaacaaaggtcatggatgtcagtgataaaccacaaagccgaggcaaaagacagtaaatctggggaagaaaggcatttgaggaactgtatgtatagaagttccccagaccgcagtcaaccaactgcatgctgttctgtgagccggagagaggttgactgcggtctggggaacttctatacatacagttcctcaaatgcctttcttcctttatgctacatcttccccaaatttactggggtcactggcaaaatattgccctgcacaaagctgtcaacagatacaaatattaagttgacaaactcttttagatggaggcagtaaggagagcatgccttagagagaaatctgtttgcacttttataaaattaatgtattctattcccctcactattgctggtaagttggtgttacagcctccattgctgtaaccatgtttctccacatagtaaatcagccctaagacacagaagaaacccagaagatttggcagtgccgacaggcatagtgtggcagttctgctctgctggtctctgagtggccatactaagtctgaagggtgaatcagatcagacccatccctggaaccagactggcactgtttcttttgccatcttcacattcttggaatctgtgctcataagggagtgccacatagccacagtgccacaatgttgtatgctcttaactacctcttttatataagcagggctttggtttgaaatgttgccccatgtttgtcacaaagaagagcatgtgtcaataagagcttttatacagatgtattaatgacagcttttattatataggcccacagctccttatggacattatctcattgtcgctctctttctccctcataggaaacgggtaggtggggacactatcatcgttactcaagaggtgacgggatttcccagggttctggaagaaatgcctgagcaaggagagcatagcgtgacttaggttcatctcaaataactctaatgtctaacatttcttgattaaagaaagctgttgtagaagcagcaaatcagaatccccgagtcaaggaaaactttgtaacaaatttaactgtactttaagattcatgacacagggcattttcaccagttttcaagtcaagactgtggttagatagtaaccagtgaaaaagaatccaacagatacaagccgcaatgtactttgcagacatctcatctacctatctttctcctatttttcaggaaacagatagtggggggcttttcattctctgacctgaaggggttggaggtgttattactgggctcattagggtccagtatcttatcaagttgtatccaatcctggacaagtatttaccaacaaattagtaggcaaggcctccaggatctgctgcgactgggttattctgttgaaatgtctctgcccctggggcagctcaaaatcagacctgtacggctgtgtaccaagttgtacagaatgaatgaacagaagtaacccgaagccagtggatcacgaggtcaggagatcgagatcatcctggccaacatggtgaaacaccatctctactaaaatacaaaaaattagccgggcatggtggtgtgcacctgtagtcccagctacttgggagggctgaggcaggggaatcgcttgaacacagtgggtgaggttgcagtgagctgagattgcgccattgcattccagcctggtgacagagcaaaactctgtctcaaaaaaaaaaaaaaaagtaacccacgtgcctttgtcattttcttttttaaagaacccaaaatataatatgaggagaatttgatattacaataaagttatctattttcctttaaatatgagcttaagttacccattttttgtactttaacagcctttgctttaccgtaaaattcagtaaaaggaaaacagaattgatatacaaaagctcagtttgtatatcttgggctcttttatatattaatacattacattcttgaatataagtgatatttaaatgccaacatgttaatgagtttgctcactctgaaattttgtggaatttagttaccatcagatttcactgaatgtgagaagagtagaataagaggacttgtaatagttaaattctctggttgattctggtaccttatctctttaatcaatattgtgctctggaaatttgagtttctgaaatctgctcacagaattgacctgcaatagcatatcaagggaaggatgctttcaagattattcagtagccaaaaaaagagacctcttgggatttggtggtgattgaatctggaaaattttaccttccagatgcttgtgtatatgtttgagatgtttttatcccaaccacatgaatattgtttttaaatgacaaatgacttactgttaaagccagagtaaacagatcagtaatgttttttgtacagttgggctgagtgtgtatacaatgaagtatttagtgcaggaggcctgttacaaattgtttattggttaaggtttgcctctgagtatggatttttgtgaagagttctggttttggtaactactaactttgaatactattttatttttttttaattgtgcaaaccatcaaaaaaaaaaaggagatcatgtctttgtcaccactctttttatttcctaatgagttgctactcttcatttatcaaaagaaggtgccacttcagggagcagaactacaaccatcttacattaaactctaacatagcattagttttataggaaaacaaactcagttgccaaatttttgcctcaaaacttataactgcttttctttcctcatgcctcccctttcaaaatactccacttttatttctaactctcaccttgcatgctacccctaaaccctgtcctcaacttttaatttcgtaaagtgtttctgaattacgttagtccagtgagatgctctgaaaaagagaagaggttccatattagaataagtgtgagaaaactgtattccatacctctttcctcagggttcacagtgcccatccgttggccctgccaggctggttctggtcacaggacctctgcactgccaagctctccctgtaggtctcacatagccagccacttcctatggtttaggccaccactgtagagtcacctcctcagaagtctgatggaccacactgtctgatacagtcatctgctcatacttctgtcctttcattgcgtttaccacctcctgatatgtcttgccttccattcttttctcttatctctttctgccatatccaccataaaaatacaatttttctaactattgtgacctagttcaacattgtatttctagcacctagaacagagttgaacactgagaaggcaatcagtaagggttatttgcacattcttgtaaattctggtcaagaattcttggcatctttttaaactccttcccctcttccattctgtttatctcagccaatcttgtctctgtgacttacttccatgctgaatattttctgtttgccacttcagatccactcttactacaccaggcgctgttctaagtgtttagtacacattagttcatgtagtttacccagtgatcgcatcagatacgagctgttaatacccacattttacaaaggaggaaactgagacatatggtcattaggtcactagcccaaaccacacagcttttaagtggttaaaacaaaacaaacaaacaaaaaaacaggttatcacgtctgtttctttattcacgctgactctgaatttcttcttcttctccactctacttgtctacatccttgtcatctttcaagggcttataacttgcctctttcatggagtcttctgcagtcattctagccagcactgttttctgtttcttttttattcccattgcatctagaattggtaccacatggtttgctccttaacttattccccaacttggttattagcctttgtgatcaaggaccatcctttaggatgtgggggggtctttgccatctcacttaaataatgttgagtgcttgctttggcagtgtgaatactaaaattgcaatgatacagagaagattagcatggcctctgtgcaaggatgacacacaaagtcatgaagtactctgtatttttaaaccatatagcctctatgaaactgccatttttgtaagttaaaaatgttcaaatattaatcgttgtaaataattgcccactggaatgttttcttattccccctcaagtttcaatttcaagcactgactgctaagattggcatgtctccagccacgtacatttgcaaaaagtcagatttgcaatgtaatatgtcatggagctcatgcttgttgaagagaatctttgataggctggacacattcattttagtaggaggcagaggtggcctaacagcaaactctaggttcaggatctaattttcatagccttcaaggatgaatgcaatataaactgtgtagtagattgtgatgctcattccaactagggaggcaagcatttgtacctgctatctacaaggcaccaaataatgcatgtgtcaccattgctataaattgtcctcttccaggacctaactatttgggtaaagaacctacagttcccatcaccacctatgtatgtatgtacaaacataaattagtccaaattctaattttctcttatttttctttgtggaaaaacagataagaaagctcagtaaaggaagatataagcaattaatgttacagttcttcaatataataatttgaattaaatgtactaagaagcaaaaactattagtgttgagactatcatgatgaagcttttggtttttttaatatattttcatttttatgcataaaatcttaatacatagaattccatgatgtcatcaggcattaacaatcacttaccttagaaaccaactctttttttctaggcttaacagggtttgtattaatgtattggcctagcactgggccctgctagatgctcaataaatatttgtctaatcactattagacattttaaaatatcttttggctgggaacagtggctcacacctgtaattccagctctttgaaaggccaaagcaggaagatcccttgagcccaggagtttgagaccagcctgggcaacatagggagaacctgtccctacaaaaaatggaaatttagccaggcacagtggtatgcacttatggtccctgctacttggaggatgactcaggaggattgcttgagcctcctaggatgtcaaggctgcagggagctgtgatcacaccactgcattccagcctgggtgacagagcaaaacccagtctataaaaagaaaaaacatatttcagtttatttttatttctgtgttaattgtttagaaccaagaaaatatgagtaccttaaattctgtaagtaaagaggaaaatgtctttaacattgtaggaaattaggaattaagtaactgcccttcatactggtaatcttgatatgttgaaggaagtgacttgttataagatagaggccaggtatggtggctcatgcctgtaatcccagcactttgggaggccgaggcgggcggatcacgaggtcaggagttcgagaccagcctgaccaacatggtgaaaccccatctctactaaaaatacaaaaattagccaggcgtggtggctcatgcctgtaatcctagctactcaggaggctgaggcaggagaactgcttgaacctgggaggcagaggttgcagtgagccgagatggtgccactgcactccagcctaggcaacagagtgagactctgtctcaaaaaaaaaaaaaaaagaaaaagaaaaagtagaataatcagtttttacttgagccaaagactaattgtaattataccctttgaaaggataaattacccttgtggcagggacacaaaccaaggtgacaactctatggaatgttccagagcagttgttctaagtccctttaagagtcaaatatactgagaaatgcttcccaaggaacaggacttattctacagtgaatagacaggtattttcttgtccaagggaacttgtggctgacttttaaaaaccagttctccgctcctccgattgagatgacctgttctgaccttgatggtctccctgtctcccctttctttttcatttgtgctgagaacacagctcttagtgtagtctacctgcagaaacacagtggtgccttctgtcattgaaggctgctcatcagcacatagttgttctatggtctacatcgcacaggcttagagtaataatgggaatgtgtgtgttcccagtccttgctgatgtaacagagagctggctgccttcagtttacctttaagatgacttcaaaacctagctcttctagttctcagatgtaaggctgtagtgaaatgcagagaacttcacttccaaaattgtataatttttacttgtcctgggcctgactttttacatagggtctgatttcacatggctctggcacaagttttcttgactgaggaagggaggggagagagaaatcagaagtagagatggacagtacatccattcactcatttcagaaatattatttgagtgtctgttaacagcactgtgattaacaaaggagccatggtaagggagagacaatatgaaaaaatagtagagtgatagatgctatcaggaaaacaactaatgggacaagcttagtcagggacatcctttccaaggagtcattaagctgaagactgatgataacaaccccagataaaggagtaggaggggagagaggttccaggcttgggaaaactagcaaactatgcacgtgtttgttaaaggattccatggtactagaaattgaagttataaataattcctatggttcttactgtctcagggtctccttaaatatcaaaatgagtttgtaaagtctagtgttaccttatttgaacttcagggcaaatgactaaaagggacaaacctagaatagcaggttttaatcagttagcatattttccactgtaggtatcagaagactcaactacaaggagattcgatgcacagggtttactgacttatgaaacaagtctggggtagggtagttccatggtaggttaagacagtgcccccaaaacattatcagggcccaggtattctccatcttttcagtctatcatcattggcacatatgggttctcctcttacagttatggagtgaacaatgccgcttttgacattgcatttctgacacagtgatatccagtgaaagaagaggggcatttcttccttctgtttcttttcagagatgagagaattttaactagagcacctccaccctctgactaccccccactcctccagtctcattggcccaggctatatcgcatgcctttggccaaactaatcactctcgaggggattgagaccatttaaattggcgtacattaattaccccctgagtctggggagggggatcacatttctataagcacattgaagggtgaacactcagcaaaattaggaaaaaattcagcaaggaaacaaaggggagtggccaagaggaaagaacagctgttgggaagaccaggagcacaggcctcaggagtgcatggcatcatgacttaggagggacggtggcagagtctttacaggatcctcagagtttctgctgcatacttagtgactgttttgttcccagcactggtgggtgaaaccgtgaacccagtgtttaggtacattcttagccttacttgtgctttctactgtatcagtgaagtgacatgaggcacacagtgccttgacgctttggcagtaaagttttgtttgtttgctttattttgtgtgtgtgtgtgtgtgtgtgtgtgtggtttttttttttttttagacggagtcttgctctgtcgcccaggctggagtgcagtggtgcgacctcggctcactgcaacctctgcctccagtgttcaagcaattctcataccccaacctcccaagtagctgggactacaggcgcccaccaccacacccagctaatttttgtatttttagtagagacggggttttaccatgttggccaagctggtctccaactcctgacctcaggggattcacccaccttggtctcccaaagtgctgggaatacaggcgtgagccaccacacccggcctgcagtcaactttttaaactttgaaatatcttatcatgaactatgtaatataaataaggaagtatatacaatttatacgtatacctcaataaaatgaaattcttatccatttctagtacctttgaagcccccatttgaccctccccaattgcatccactactctccctgagaggtaactgctaccctgaatttctgagttaatgattctcttctcttcatggttttaccatgtatgtatgctcccctcagtttctttctaaaacttttgcatgtaacacctagagaacttgttaaaacacagattgctgggccccaactctgaatttgtgattcagtaggtctggagtgatgccaaaaatctgcatttctaacaacttcaggtcatgctaatgctgctggtccagggaccacaccttgagaaccactgctgtagcagggggctgttttgcttttgcctgtttataaatacaagtatatcatatatattcttctgtgacttgctttttttcaccggaactttgtttttgaagttcagctttgttgatatgggtagcgataggtcaattcatttccccattgcttagtattctatttctcattaatttttgtccactgccctatgagggaagaggaagaaaaataggaagcaacttgcttaaggcaccaacagaagtgattctgtacccctcaagcatccagcaccaatgacccttggctcacacagctcaggtcattgttgctgcctttggaaggaaagaggcagtgagatatcacctgtcctaagagccctggcctcaccagaagttcaggaggctttgagacaccaggcacagcaggacctgcagacctcccagagccctcttgtataaaatagacctcaaataacattggcctaccctaatcaaatcaggatataaggggatggaagggaaggtaacaaacttaatattgatttcaaatgggctaggcactattgttgaataatgattacaaagcactagaagactgaataaaagtatgataaaaatacgttctctttcaacctctcaacattcatatgtggtatatatttttttaaaacttgcccaaggtcacaaacttaatacgagatagagtcagattttaaacctagctctacttataaatcatatcattctttcactttatgctgccgcctcgctaagacttaaatgtaggccttccccatccttggcatctacctacccactaaggcatactcccctaatgtatgtgaaccttctctgaaacctggatccaattagtgttacctgaaccagctttcatggttctttccatcatagttgcaacagatgtagcataaaaaatagtgggagtgacatgctgataccttgcactgtctttgttggacttgaacgtttgacttggatttatatgcctgacaactaactatactgccttgtgtttttatcctgcagaggatttccaaagaaggccagtagaactgctagaatagcctccgatgaggaaattcaaggcacaaaggatgctgttattcaagacctggaacgaaaacttcgcttcaaggaggacctcctgaacaatggccagccggtactgatagatttgggacctggacttggaatgttagctacccacatacctttcttcctttctctaagacttaggttcttgatatttgtccacaacatcatcattattattattattatttttgagacagggtcacactttgtcacccatgctggagtgcaatggtgtcatcacagctcactgcatccttgacctcccaggctcaaacaatcctgtgacctcaacctcctgggtagctggaaccacaggcacatgccaccatgcctggctaattttttatttttgtaaagacagagtctccctatgttgcttaggctggtttcaaactccagagctcaggcgatctgcccgccttggcctcccaaagtgctggaattacagatgtgagccactgcacacagccacattattttattacccttgaatctcaacatttctcttgatattaggatttgaatccaaagacaaaagagaaaacgaaaggccttccttctattcagtcttcactgctttctcctatgcaaaaaacctttctaagagtgaagagagtaagtgggaaagaaaggaagaaggaagggcagatatctggttgggagaggaacaaatgagcaatgccaatggtattaaaaaaaaaaaaaaaggaacacagggattccattctggctgatagggttggggagggatggagaaggtgcgctttggaatggtttgtatctacccagaaacagcgaactgcaatgaaagtatcaaaaagagaatttgttttccatggtatgtactacttacacacgcacacaaatctactagagaaaccattggggaagttctgttcttttctcccagactactactagatattaattcagcatctgaaagagtaaaggctgttccaaaatcttgttctggtttgttagagcaagataactaaactgtaggaaaaaataattattttacagctgcagaactgtagagtacctaaatagatttggtaaaatatatagataagatgttttctccactggatttaagtctttcctcatcagtttttgtttgttttttcatctcttttgttgatgctatccttttaaaatactcttttctttttaaaatactatttccagaatattttaaggggatgggaaaagcaaatctagaaaataagacttaccaggtaaaggagaggaaccttctgtagctttattaaggaattgtcactggaaaaatttgcctggctcttaagtacaagacaaggatctttttgtataaaatctccctttcagacacctttttcagagtagaaagctctctataattatgttttctgagaattttaattatcaaacattgataagtaaaactgtgagaacagaccacacttgaaagctggagagcagaggaggggtgctgaatgctgattttagtttattagggtatcttaatctgattaagaaagattaaaatttcaatgaagttttgtgttagttactcatttcactgagtatagaagattttcacaagaggaaaatattttctccctgaaataagtgattgcatgtgtaaatgtacatactctggaagttttccctggctctgtcaactaaatcttttaaaagattaaaataaatacatatgggaactttttcaagccaggtaaggcatcactccagcttttttttttttctttttggctgtctatgtcaatgttccttatgaactaagattctcttggttaaggtaagacttccttaagctattggtcaacccacattatatatattgtatgtatatttatattcatctgtttagcagtgaataacattcacagtaagttccacaggtatccacacttgagagcttaaaatgacaagtaaggtttccctttttagaaaatgggattctcaaccaactttttcctaatattatatatcattctctttcttatctttggtgtctgtagacacgggcttttatagccagatggcatagtgacttagaaaaaaaactgtgaagtatatttggcttctagtggtagcaggtgcattctggtgaaggaatagatatgaaattgatatttctgcttataaggaacagagtgaaaatcactccaggcctgcctttgatgtgttacaattctccgtgaaaagattagggaagctttttaagagatcaggtatttaagactctctttgaaaattgaattcactgattttttaataggtgtgagaaaattaatttaataacatagtggactcagatgcttcatgccgccctcagactcctacctctgcctcttcttgtcctctgacctttctttattaagtgaaataatttgaactgcaggactatttgtcatttggcacttgacttgtttcacttcccggtttcagctgggattgagatcagcaattactggaaattgtaaatttacccaacatattttcctgattagagagcttccaatcaaatttgcatttatatttagaagtttggaagtttatctgaaataatttctgtacattttttagattctgccttaccaattattctctatttctaatcaaacacttgcttataaaatgctcccgatgaggcaggtggtatctgaaagttccttccaaacctgtaagtctaaggcactttagaatgagtattcaagagcaggtatcaccccaacagtcacacaaaaatgccggcatttcttatgtataagaatggcataggtaaaacggtttgggccaattccaaagtgctagctgcgagatgcaagaacactaccactttctttgcctgatgggcaagcagtctgcttctgggtcaagtcaattgaggctgttagctttggcaagtgtcttgtgtaatcctgttgctaattcagccatgtgcatcattctctgtggattataatagttgccgccaatcccctacattacacagcagcctgggaaatgctcttagaggtaagaaccccatcactgccagctcatccacatcttcctttagctaaacatttactgagcacatactgttaaatgactgatagaattatttccattagcgatacctgttctttttttagtcagtttattctccttttgagtatctttgttttttctttcagtcagtattagagctgacttgggtgttctgaagctgatggatggctataaaaataacatttcttttaaattgtattttgctgtttaaatatctttttttccatgtttttcattaaggacatgacaaatcttttctgtgtggtttcttccttgtcgcttattgctcactttaaatttgtgctgtaccaattggtggctctctggattaggccattagtactagaaagggaggtaaaaaggtagaacaactgaagcaagaaaaagaaatatgcaggtatctgaagctggagagagaacacttacagaaaatcatgaaagtgtgttgttttttactctttttcatagggcagtacatatttgtgatttttttctaattttgtattttttgtgacttacgttgtttagaggttaacatacgaagaaagaatggctcgtcgactgctaggtgctgacagtgcaactgtctttaatattcaggagccagaagaggaaacagctaatcaggtaccatgttgctctggacttcttagggtaacatttattctgtcccccttttccatcttccttatggatactgttcttgggatgagttctgtggaaagtagagggcaagtcacagaaaagcagtattaatatcatcagtcaacctcacagctaatttttattgagcacatactatgttaagtgactgacagaattctttccatcagtgatacctgttctttttattcttcttcttgattattctcctttccagtacatttccattttcctatcctaagttttatgcaaaataattttgtgtggagaaacacattttcgccgacattgtctgaaataactagtgaatatttcccattagagttggaccttgaacaacacgggagttagggggaccaaccccaagcacagttaaaaacccacatatggccgggcacagtggctcatgcctgtaattgtagcactttgggaggctgaggtgggtggatcacgaggtcaggagatcgagaccatcgtggccaacatggtgaaaccccgtctctactaaaaatacaaaaattagccaggtgtggtgacgcacacctgtagtcccagctactcgggaagctgaggcaggagaattgcttgaacccgggaggtggaggttgcagtgagctgaggttgtaccactgcactccagcctggcagcagagtgagacttcgtctccaaaacaaaacaaaactaaaaacacatatacgacttttgactcttcaaaaacttaactaacagcctactgttgaccagaagccttactgataacaaagagttgattaacacgtattctgtatgttatatgtattatagactgtagtcttaaagtaagctagagaaaagaaaatgttacaaagaacatcttaaggaatagaagatacatttacaattcattaagtggaagtgggtcatcataaaggtcttcatcctcattgtcttaaattagagtggtctgaagagaagaagacaaggggttggtcttgcttatctcaggggttgcagaagcggaagaaaatccatatataagtggacccatgcagttcaaacctgtgttgttcaaagatcaactgtttagtcttaatatctagtcaaaataaaatagaaaatattatctctttatcttctttcacatatatacagatgttcttcaacttagtatggggttatgtcctgataaactcattataagttgaaaatattgtaagttgaaagtgcatttaaggcggggcgcagtggcttacgcctgtgatcccagcactttgggaggccaagaccgggtggattacctgaggtcaggagttcaagaccagcctgaccaacatggtgaaaccccgtctctactgaaaatacaaaaattagccgggtgtggtggcgtgcgcctgtagtcccagctacgcgggaggctgagacatgagaatcgcttgaacccaggagacagaggttacagtgagccaagatcgtgccactgcactccagccaggtgacagagcgagactccatctcaaaaaaaaaaaaaaaagtgcatttaatacacctaacctactgaacatcttaggttagcctagtctatcttaaatgtgctcacaacacttacattagcttacagttgggcaaaatcatctaacacaaagcctatttaaaataaagtattgaatatctcatgtgatttatggagtcctgtaccaaaagtgagaagcagaatggttgtgtgagtactcacagcaccgttactaccaaacgcatattgctagcacaaaagtttcacttaaggaaaattagaaatcttgctgcattcttattatttctattattagtcttcacatctttttttctaccattacaggacattggttctcctcatgcttctgtagggagtcctctggatggtcaaaaggttaagcttttcacctttcttctccttccagtctttctctgtgtctgttttcttctgttcttcctgttttacgtgtgtttctatcttttctgccatatattaattataaatgctatgaccagtgtctgtttcatttaatatcagatacacaaaattactgcaacatgagttttcttgtcatgtatttaccagcttgaatttatttatttatttttactttatgtatttatttatttatttatttattttgagatggagtttcgctcttgttgcccaggctggagtgcaatggtgtgatcttggctcactgcaacctctgtctcctgggttcaagcgattctcctgcctcagcctcccaagtagctgggattacaagtgcatgccaacatgcctggctaattttgtatttttagcagagatggggtttcaccatgttggtcaggctggtctcgaacttctgacctcaggtgatccacccgccttggcttcccaaagcgctgggaatacggcatgagccacagtgcctggcctctgacttgaatttaattctgtcattagtggatactctgaacattaaatcaagaaaaatttttcatttgttatatatacctttctatggggaacaaaagtgctaattcttcaagggattaatttgatagtaattagatgaagcaaaacaacttgtggtataactcttgcagttttattcatactgttgtatttcttccctcaaaccaacaaacttgttttttaaacactgagtaacttctttaagagaaaacatagttaaagttatctttcatttaatattaaatagggaatatttacatagactcccttgtcttcattgcacttttttgttttggagacagggtctcactcttttgcccaggcttgagtgcagtggcacaatcacggcccactgcagcctcgacttcccaggctcaagtgatcctcccacctcagcctcccaagtagctgggacaacaggcatgtaccaccatgcccagctactgttctttttaaattttttgtagagatggggtctcactttgttgcccaagctggtctcaaactcctggccagaagcaatcctcccacctcggccttccaaagtgttgggaattacaggcatgagccactgtacctggcctttaatgcactttgtaggcaaggaaattgtaggatccaccgtaatcaccacaggaatgttgatgggttgttttttttttttaaagcaaaattttggctagactgtcagtcctattttttcttctaaagatggtgggttcctaacagctgcagagctgaggaggcggcccttgcaaggcagggattgttagaggtgggggaaaaaaaacaaacatttttttttttctattattcttttactattttttctattaccattttttctagtaccattttttctattattcttttactataattgtatataatatggcagctgcttgccacatgtactatgtggagagatgtaccaccctgcatcagcttttaccctacagaaggaaatcagcgttccattatattttattgttatcaacagtttaggaatacatagctttgcttttgcctttttctttccttccccttgtttcccctcgcctcagagaaaagaaggaaaaaaaaattcatctttcctacccccctctttttggatgataggacttgaagacaatctgaaataccacataaactcacttccagatgttttttgtttcatatgcaattgaattgggctcagactgtgtttttaagctgtatggtaaaaatatcactgtcttctagggccttattggggggcagggagagacgtgacactttgtcagaagggattgagtctgctaacttaaactttccttgattcaggaatacaaagtctccagctgtgaacagagactcatcagtgaaatagagtacaggctagaaaggtctcctgtggatgaatcaggtgatgaagttcagtatggagatgtgcctgtggaaaatggaatggcaccattctttgagatgaagctgaaacattacaagatctttgagggaatgccagtaactttcacatgtagagtggctggaaatccaaagccaaaggtgagctgggagatggaggctttttaagagtcattctctgaggaaaggtttagcttccaaaacatagcatgccagtaggagaaagagatacaaatgatctttctcaatacccacgatataaagggttttaaatattcttaagttctgggccatcttcaggaggcattagaaaccaaaaaaggtggtggggggagtggagtttgggtttgaagaatagagaataactaacagggagctcttcacacacctatatcatttattcctcgttgttattcccaaatcacaaataactaaactgagttctgtgaagtgagtttccaaggtcagagagctggtgagtggccaggcctgcatatgaacccagtgctctgtaccatacagacaagtaatgctcaccactggttgtaaaaacttccaatctttaatcaaaaaaccaaggctgcttatattaatatttacagagggaggtggggtgaagaatattgtttagaacggataatgacaaattctgataccatgcaggactaggatgacctggatgggagctctctccatacaaacatatggaaatgctggataaggagctgccctatctttaaaggaaggactagaataactgtttactagcccagcaaggcagtaaacaggagtacacttttccctagagcttgagtgaaaagaataaaaaaaagggaaaaaattaaaacccctaaactacactatcacatgatagggagccaaaagctgagaaatgtgaaatttagtgctggatgattaaaattcttagaagcaagcaaaaagttgccttatataaaggtaataatatgtgaagaaataaccatgaggagagttgtgttaggccgtttttgcataaagggattcctgagactgggtaatttataaagaaaataggttttattggccaagcatggtggctcacgcctgtaatcccagcattttgcgaggccgagatgggtggatcacctgagctcaggagttcgagaccagcctggccaacatggtgaaaccccatctctactaaaaatacaaaaattagctgggcatggtggtgggcgcctgtaatctcagctacttgggaggctgaggcaggagaattgctggaacccaggaggtggaggttgcagtgaccaagatcgcgccattgcactccagctcagggcaacaacagtgagactccgtctcaaaaaaaaaaaaaagaaaagaaaataggctttactggctcacagttctgcatggtatacagaagtgtagtaccagaatcttctcctggtgcggcctcaggaagcttacaatcatggtgaaggcgaaggcgaaaaaggtgaatcacacagcaagagtaggagcaacagagagaagtggtggaggtcccagacttttaaacaaccagatctcatgtgaactaattgagcaagaactcacttaccaccaaggggatggtgctaaaccattcatgagggatccaccccatgatcccgtcacctcccgccaggccccacctccaacactgggagtcccatttcagcatgagatttggaggggacagacatccaaaccatattaagagtcatagtacaagaaacagaaaaacagaaggccaagtattgcacaatattgaacaatcttaagtaacctctaaaataactttaaaaagattgaaacaattttaaaaagaatggaaactataatgaaagaacaagatagtaccaaaaaatacaaatttataaaataagcatagagcaatgtactcaatgaaataaaaagcttaatagtggcataaaatgaaagagggaaaagtgataaaaaaatacctgacacttttaggtgttaatttcctatagctccatggcattgttttgttttcccaccatggcaagttttaccatcatgttcttttcttaaaactgaatcgcaacgccaaagtcaaagatcaaagaaaagagccttgaattttcaaaccctatatacttcctaataaaatgggatttttaaaataaactccattgttatagaaaactttttacaatattcttggcataatctgcattaacaactgtgtattcacaacatgttatcaaacgcatgtattaaaaataaatttgtagtttatgaacgaaattcaataaggaattatatcttgaacttccaagatattcacaagaagattccatattactttcaaaccttacacaaggcttaagatcactgatcaaattctaagattattgattcttatagaatactacattaacatgaaagatgggcttttgtttttaatatgactgtacttttttcctaatataaatttaaatgtttcacagctagaagggacttaattgtttaaacttttcattgttaaatgttattctttcatccctccttcctctccctcaaccttcattctccttctcattgttttcttccctctctcatttattaaaggtctactttggcatatgccatataaattacattaggattgttaaagtatggaatattcatgtttaaagaaatacatgtttttttaggcttatgttttaaaaatattttattcctcccttgacatgcttgttctagttgagccataggaagactgaaaataatttctgatttaccctgttctcgtgcttgtgccctcccgaatttctccctccattagtacgcttggtaaaattttggaaatatttcttagatcttatttgaaagttgtatgccaagtataatggaggtgaaaaatatgattaaagaaataactcaagaactggcattgtggcaagaatgcaaaagggaagaaattgtatacttattacagcttcttttttccatcagaaatagtcaaccatagccaggcacagtggctcacacctggaatcccagcactttgggaggctgaggcaggcagatctcttgaggtcaggagtttaagaacagcctggccaatattgtgaaaccccatctctactaaaaatacaaacattagctgagcatggaggcgcacacctgtaatcccagctactcaggaggctgaggcaagagattcacttgaacccgggaggcagaaattgcagtgagccaagatcacaccactgcactctctagcctgggggacagagctagactcatctaaaaaaagaaagtcaactactaaaaagtaaaataattatgaagtatgatactttacataatttaagttttacaactcaaagttattagtctagttggtgattactttttagattctagagtttaatacgtaatatagtttctgtaaatttggagctacctgaaaaatacgagtttgaaaagttagagcagtcatatcctgataattcatccatttatttagtgctatatatttctggtcttttcctttcttagaatgcaggtttcaaaaagatttttcagattcaaatactttgacagacagttgaatttgaatgtcagtttatgttaccaatttacatactgatttatattaaggaagaagtttgttttaacaactaaagggtctaaagtatatttgttttgttaggaatcaggaatacttttggctgcaaggaacaaaaaatgacaacaaataacttgctgtggcttaaaaaaggaaaggtttatttgcttatctagtaagtctgcaggtggggtgatgtagctattaattcagcatctcagccatgttagggctgttggcactgtgattcattatgatgggcctatctttcaactgtgttgttcataacttaaatcgaaaataataatgaacttagccaggcatggtggctcacacttgtaatcccagctactctggaggctgaggcacgagaattgtttgaacctgggaggcggaggttacagtgagccaagactgcaccaccgcactctgcactccagcctgggcaacggagcgagaccctgtctccaaaacaaaacaaaaccttagaactcggacatccatggacaactggttttgtttaaaagtgagggaaggaaggaggaccctttggactacttaaaaatattgtatttaatcaaaatttacttttattttttacattgtttcttttgagacagggcctcagtcacctaggctggagtgcaatggcatgatcatggctcactacagcctcaacctcctgggctcaagcaatcctcctgactcagccttccaaatagctagggctatagacatgcaccaccacacccagataatttttttattttttgggtcttactatgttgcccaggctggtcttgaattcctgggcttgagcaatcctcctcagcctcccaaagtgctgggattataggtaggcatgagccactgtacctggcccacatttaattttttatcaacccaagttacatatctgaaaattattatacttttcaatactactgtgttttctttaacataatggggataggtgacaaacatttaacctttgatcatatgcttcctggcccagaaataaagcagtagtattccacccatcaccaacccttagtcatcacctccctccctaccaacctcttttatttgtcaaacacaattcagtgaaatgattagagtttggggtctgcttttgttctccaaaacaacctttttacctttattttataaacaatacattttaattgctggtacatttgaaaaaagaaaaatggccttcatagaaggccacttcatagaaataatggcattctatgaatgccatgaagtaatgccacttcatagaaataatcattgccaaaattcaatatatcccttcatataaataatatatgaatgtaagtgcaatatttttaaaaacaaaaggaagatatataatttaaaaactcaaatagaatttaaattgttacctgccttttttcagtgaaaaatcaattccttagtcaggtatttggtttaacattttaacatgaaaactcagatcagctctgcaaaccacactgttactattttcagttctccaaatagagtaggaatacacaaactcctaatctttaatctttgtttctattcacagatctattggtttaaagatgggaagcagatctctccaaagagtgatcactacaccattcaaagagatctcgatgggacctgctccctccataccacagcctccaccctagatgatgatgggaattatacaattatggctgcaaaccctcaggtaaagaagggtataggtctgggctcagttctgtgtctagtgcttacaggcatttgattagacaaaggaactatttaaaaggtgaagttaagaagtttctttgatttatgaaactatttttccaaattctacatccatcttggtttcagaggatagaaaaattctttgtttcatgaatacttatttattccatcaggtgttattctactccttccacaaatattattaagggtctaatatgtacacactttctatgtgggtgatggggttgcagtggtagactggacaaagtcctatggtaaaaaataagcaattaacaaataatataacttcaggtaggattacatgaagaaaataaaggagaaaaagagtgagtggcatgcataggctgtataagaaaaactcaacaaagtaaaatattttaaaagaaacacatcagtgggatttaatgtgcaaatgtagacaaatgataattttgatagcattcaggtttatcagttttcatcaaaatgttttctcttgtatttgcctttagacttagggtcaaaaaatcagttgccttcttagaatttaataggaggctgctgggtatcatgttgccagttcgagcctgcaaattcttttttattatgttatacattttagtcactatgctggatataggggatacaaaaatgagtaaaaagttattttgtaccttaagagctcaatgtatgacaggtagttttactaaagtctgcaaaagtagtataaataacacacttttaaaaagaaaaaaaaaggcatggtaaaatgagcagttttctctagaagtcatctttttagaatctctgatctacttatatcattccatattatttcttttgaagaaaatatttagcattagaaactatataaataattttaatgacactacaaacttttaattaaagtttctggcccaggtgcagtggctcacatctgtagtcccagcactttgggaggctgaggcaggtggattgcctcagccccggagtttgagaccagcctggccaacatggcgaaaccctgtctctactaaaaatacaaaaattagccaggtgtggtggtaggcacctgtaatcccagctactcaggaggttgaagcatgagaatcacttgaacctgggatgcggaggtttcagtgagccaagactgcaccactgcactccagcctggttgacagagtgagactttgttttttgttttgttggttttttttttttttttttttttttttttttgagatggaatctcactctgtcgcccaggctggaatgcagtggcgcgatctcggctcactgcaagctccgcctcctgcgttcacaccattctcctgcctcagcctccctagtagctgggactacaggcacccaccatgcccggctaatttttttttatttttagtagagatggggtttcaccatgttagccaggatggtctcgatctcctgacctcgtgatccgcccgcctcggcctcccaaagtgttagcattacaggtgtgaggcactgcacccggcctgagactctgtttctaaataaataaataaataaagtttattcaaggtttattatattctaatattccatggtcatataaatatatttttctgcaataatattaagatcagaatgaaaacagattatccagctaatcaggttgtgatagagcacagcaaactcttcactgttaatgaaaagcttctatattaatgcacattcttaaagttctaaatgttttaatcaatgaatacatgaccatcaccctgaaaaagtctaaatcactattaagaagttgcattttaatgtttgtgttcatatttgatatatatgaagaaacaaaagcggaacttgcttttttttcttttttttttttttttttttcttttttgagacggaatcttgctctgttgcccaggctggagtgcagtggcatgatcttagcccactgcagtctccacctcctgggttcaagcaattcttctgcctcagcaccaccacgctcagctaattttttgtatttttaatagagacggggtttcacctcaggtgatccacctgcctcggcctcttttttccttattatattttcagtgcatttccttgacattaacaaattctagcttttagtttagttttctgcctgtttaagaaaatggtggagaactgacaaaatccaaaatttttcttcgtgttgggtcatttattcctcttttgccctagaaaggctggggtatattatgggatggaattatctgtggtccttacgtatttgccaacactgggaacctgctattaatttcaagacatttttcttagcatgttttaaattgttattggaataagccattttatagaacaaaagaacataaacgtaaaactgcaattgtgagtccgcttagtgtcttcctcaaattataataatgcatttttacatgtggaaaagttctcagtgaggaaggactgactcagtgctcatggccaatggcagtgtgcagagtttaagacagcaggccagccttgggggtcagtagtctccagtcatttaaactctcttgacaaattattatgaagtcactagatgaaggtgagctgctgaaaatctcccttggatcattccatattacatacatataatatcacattgtaccccacaaatatatacaattataatttatcaattagaataaaaaagaaatttttgtttattcatttagagacaaggtcttcctcagtcacccaggctggagtacagtggcataatcatggctcactgcagcttagaactcttgggctcaagcagtcctcccatctcagcctcccaaagcactggaattacaagcgtgagccactgccattagccaaaaataaatttttagaaaataaatgtaatcttacccaaagcccaatatataatgccaaaaaaaagaaacccttgttaacataggaaaaaaaggaaaggaaggaaataaaaaagaaatgttactacaaataccaagattgtagggcaacaccgatgatactgaaaaaacctaggatgaggccggcaggccatgcagtacaggggttatgagcatgaactttggcatcaggcaatctcagctggaattctagctctgccactcactacctgtgtgaccttagcaagtcacttaacttctctgtgcctgtttcctccctcgtaaaatgaggatgataataataataataataatacagatttaaatagtacatgtaaaaagcattcagtttacctggcacatactatgctttcaataaatgctagttactgtcattattttaattcagagacagtaactaccccatcttaaagcaacaggcctacaacagaagcctgtggaaccagatgtaaaggatcagttctgtgtctaggtactccgttcccacagtactgtcagaaagtaagcaagtcaatttgggatggaatttctacccagtatgttgttgctgtgtggtcttctgacctcctggcttttccattttatcacctccatgggaaaggacttaggcagcagatgtggctgtgccacaactgccacagctgtgggcttgggtggaggagctgtgagctagaggacggccacacccatagcacagctgacatcagccacacatgaagctgggaagctgctctctactctcagcaccctcagggccaagagaagccccaaaagagagtggttactgcccttattccaggccccagaattctctgctttgcaaatcccaggctgagccccatggttaaccctctctggttctttgctctaccctttggagagaagacaaagcaatgagaagtggaccaagaacagccctcctaatagaatatcctatccaacctgtgatttcagccaagggtaaaataactactctgggtctatcaaaaggagaaaaaaaaaagattcaaagaacccagagcatcacagtaaacagaccagtttctaacactacctattatagtattccaaccaactccaaagatcagttgacactcccagcatcttaaggggtagggctaagagtcttctttacctaaataacccaagacaggcaaaaggaagggaaactcatgaagtctaggcctcagtgtgtaaatgtatatatcccactgaaattgctgtgagagaattttgatatttatgccacttagcagtagtagtatttgttccaagtttctgagcatgttgcctagttgattttaattccaagagtaaaaccccttcttttctgtcttgggggcttcagtaactggtatgtccaaatatggcagatataagttctgtgagtcatcacttaaaaattggagtgaacttcactatccattagcaaaacaaagtggcatttaaaccatgaccagtgacacaccatttttctacctaactcttggcataagttaccatttgttgctgtaaggatgccattctggaaatgtttaatgctcttagaatctcagctttacaacatctattaccgtatattaaaacttttttcttataatttatgaattaagacatgagtttaaatagtcatgtcataaaaggtggtgaaaaaaaaattcaaaatagctaaatctttcaagatatagtaatcccaaaagcataaagtgtagttgacagaaaactgaagttgactccttacttccttaatgccctttagttaccttaaattttgaaattttaaagttatttgagtttagaaaaaaaagtatttgggtttgaaagggagaatacatgtatgttttctagtacactgtagcccagatgaaatgaaataaccaaggaaaagaggaagactagagtggaaaaattagttcagtaatgaaacacagacggtagagctctcctgagcagtggaaaataattacagaaagcagccaagagaagggtgagaaccaaggagggaggaaaatattaaagttcagcagaatattttatagaatatgatatttttccacctgggttaatcttttgggaataagaaaaacattagatattgttgactgcatccaaattctacttgggatagaacacacagctctaaacatatactgggctgtgtatcacactcgatgtgtgtagctcaagcaattcataagagaccaaagcaatcacatagtttagcaaaataatgagtgactgtgcagttacaccaaagagaatgccaaaatgaggatcacaaatacagtttattttagactctaatcctatctttaagaacaacgacatctaaacacgaatgttttactttgttttgttgtgttgctaagttactttgtattgcacttggattttggaatggctattttgcagtctgatgtttcctcaaactgcattatgtatacaagtggcaagcttttatgaagacctgtgtgccacaagttaaatttcataaactatgaaatataaatgttatttccatattacataaataattggccttgcacaaggtatgaaataatctttacaagctggatgtttaatacagaatcacttttagaattcaaacttatttgtaatataagctttaaactctgtggatttgtttggaatggaaaagtaacacacaactgagttaaatataaaatgttagtttgttgcttgtgttttgttttagcattataaggtttcctggctcatttcaagcttcactctaaacattcccttccattattcttatgttcatagtaaagcagatagaaatgagaaaattaataaaagcaaatgcagcagcattaatgtgcatcagagcctactaactatgattaccagggttaataggcatattattattaaaatcacttattgctaattctatatgacctttgtcaaaaatagtatgttcagacttaaaaacctgaattttctattatgcacatggaaggcatcttttcaaaaaagcttcactgaactctgggggttttttcccccaaacaaaaatgacaaaattatacaacttcttagtttggatgctctctaaatgctcctggttatgtattggttagtaatatatttagccaataacactgtataaatcaaactaataattctgcctcctgaagaccacaccttcccctttcatgttcagaagtgcaggttggtatcagaatagagagattacaaatgataactattcctttttcttaaatttgggaagttaaggaaatattctgtggcaatatttgtatatatggttctaagcagtagcagcaaaaaccctgaaaacagtgtagaaatgtgtgacctttccagagtagtatgccaacctgtttactttttttttttttttttttttgagaggggaggaagaggcaggctaagcatatcaaggatctgtttagagctgaatagggcatatttttcctcctccacatcaaatgcagccatcacactaacaagtacatttcagtatgattgtgcttagcacctttcaagcaccagcagaagttaaaaaggttaatctgcttcccacatagtctgcctcctgtgccaaaggtattttgtttttcctttggagtaaattacattctaataccaagaaaaataaaattccattacataaacaattctaaaggatgcctcaaaactggttattataattatatccatagtgagtgctacaataatttaacattttgagcattggcttcatgcaaaacacaatgctgcccggtgctttacaagtattaatgcctttaatcttcataagaacccattaggtattaactatatggccttgttttacagagaaggaaacttagaaagattaagttacctgcctaaagtcactcacctgtaagggacagcagaactggtttacaaacttagactgattccagagctactgaatgcaatacgaaggtatttaaggctcattccaggattaagagcactaagtggcaggggagatagtggttaaatatgaaagaattttagaaggaggtaagcatatacctcatgtaaagtatattcacatggaaattcttgctggggtccgccaagctgctggggctcctaaaaaccatcttgatgcatgtccatgcataatgtctcagacccatgataacacagtaccagctatgaggaatttaataatgataatttatgatgtcacataccatttgatatttatgagagcatttaggttacatcatttaacccttaaaacatccttgtgagagatatatgtagcatccctatttgtacagaaaaagaaacaaaggcttgaacaaattcagtgatttgctcaaagttttaggaaaagtcagcactcaaatccaggttagtgaggtgtgtttgtttgactgtttgtaacaacccatacctccttttccaaattcaagtttaagtctgaatttaacttacattatatctttttctaaccgcataaatgattagttcattttaacttaccatggatcttctgagcttcatatcacaaggaaggatatatccaaattataagcatttcatcatggaagccgcaaagcacataataaggaagccatatcccacatcaggacaattggaagctatttgtgtaaaacaatacacacacttccttgtcctcaacctccaaaaagaatcattaattttaagtgttcatgtgttatcttgtatgatgcatcagttggatagttcatgatggaggtcttctaagcaagttacatctagattttctacagcaagtacagatctggagaacttggatgaaattaatttttagatttcaggctagtttagggaatcccaaatgtttgccaagagtttagcataagaatctgtatcaagtggcctgtgcttcaggtacagttaatctgagctagaaataattctccttcataatgttagacttcatgtctccttggaaattttcaggaaacacagtgttttaactatgacctcaatagcaaacaccgtgaatgccagacggagtcacatatgtagtggtataaaactagttatgtttgtttctttgtgatgacctctctttggtaattcctcattcttctcctgtctgtattacattcctatgtgtctttgccttttctgggtggttatagccctaaagaagtccaggttttaggagacctagagaacccccccagttagagtcctgcccttcagtgaatcttgctatgggatttttctctgcattccctccactagtgccctcaccctgacccccactccagtctactcacagttggaaagcagttcttcaaaacacacagaacactgcagcttctgttacctgtctctataggcagcttgcaataaaaatgacagccaatgggagaattttattctgagtgtaagtgcatgagggcttctcatcaactctgagctagaactcactaagtctaatcattgatggtacatctgcttcttgtttttcctctcttgctgttacctttggcagtcatcacaatttagaagcacatcttctcattcttctgagagagtgaaggagaaaaatcatcttttttgctactctgctggtaacagtgaaaaaaacaaattaagagaaagggctgaaacaaaaaccaaagtaacaatgtgtggcttatccatgtcatctgggtgccctgagtattacttgtctgttcacatatgacagcgtttatcaaactctttttttgcttttattatttttagttgacacaatgattatacatatttatgaggtacagtgtgatatttcaaagcatgtatacaacgtataatgttcaaatcatggtaattagcatatctgtcacctcacttatcatttgtgttggaaatactcaaaatccactcttccagctatatgaaaatacacaataaattattgttatcctacagtgctgtgaaacactaaaactttttcctcctatgtagctgtaattttgtatccattaaccaacttctggctatctccccgaccccaccaccccgtcaaaatttcaattgacaaatttaagagaacaaaatataggtttttttaattacataggcccttatcatatgacccacatattttaggtatttaactgcttctagtttttaaatctcaaatatgttcatttcatgagaacatggcttcatttagtcatgaagctctccttatcatcccacgcatacttcttacataacactcattttatcatgctcattttaatgtatggtttggggaagggatgccactaacttttttttttttttttttgagacagagtcttgctctgtcacccaggctggagtgcagtggcaccatctcagctcactgcaacctccgcctcccgggttcaatagattcttctgcctcagcctcccaagtagctgggactataggtgcatgccaccacgcccggctaatttttgtatttttttagtagagacggggtttcaccatattggccaggctgggctcgaactcctgacctcgtgatccacctgcgtcagcctcccaaagtgctggcattacaggcatgagccatcgtgcccggccagccactaacatttaattagtatattactataattagtatattactaaaaagagaaaactgaaatcatctaggtttgatttcagaattggctacagctggtagatgaccatgaaaatggaatcttcacaagagactgatgtcctcctgctatattttacaattcaacatcatgtgttacggagacctttgcaggttacaattaatcaagggttgtcattttaaataccatcctagataaaacagtaaagcttatttaagagttccaaaaaaagaccttgtcaccttcaagttcttcaagtaaaaatagttttactgaggcacttaactcacagggaaagtgtttttctgaaaagggttagtcattactcaaatggcatactgaattttttatgaaataatgtcttatagagaataggacagtaggcatgatagtgcttagtggttaatagttttaaatagcaaatcatttatttcctgatatttctacagggccgcatcagttgtactggacggctaatggtacaggctgtcaaccaaagaggtcgaagtccccggtctccctcaggccatcctcatgtcagaaggtatttaacatgttccttcccagaagtgttacattattttatttattactataaatgtagtactattagaatcatcatatgaccacaaaagtaaacataactggaagatagaataggaatgcaaacctgaagcctgtggctccttgattattatgctcccttgtgatgcagaaagggaatgggaacaaacattcgctaatgtgtgctaagcccattcacatatactattagtttgttaaataagacatattttatagacaaataaatcaagactcagcacttttaaatggcatatgaaaatactactaaatggtacacaaatgttggaaaccaaacttctgtaaccaacagctgtgtgagtggacgcacacattaaaagctattaccactgggtttcttaaaatcagctcatttgttaatgttcatttttcagccacttagttcaaaacataagaccattagactacaaatcttgtaggtaagatctgtcacattttaaatactcagatatctgctagcaatagagatgctttccattcctagtagttctgagtctatgcaaggacactgatggaacaatggtaggcagagatagagaaaggattattacttcttagtaacacatttgcacttaaaaaaaattcagtaagtcaaccatcctgtcaacttggcctgtttagatattttatagacagaatatcctcaaatagtcctgagtctaaattacaggccataggtgcaaactcctttagtgaagagaatacatagttagctcacagagagtaggcaggaaaactgagtaaacatcaaacaagtggtgtgtgactgcatccacacagacttttgttcaacatttggaagacagttctggcaccagagcatgtgtagatttaattctaacttcatcatggcaatacctattcacaggatgctagcctgtatctttgggtataaacatagcatatacaggattaggtccattgtcttgcattattctctttgcttctcttgttgtctgcaacacatttttaagcctttccttatatcagtgggtcctggaaagctttttttcccataaattagatctatacttagagaagggtaaactatattaaaaagctaataattattagcctagtatgcttctttcatttgttccactcttgcttttcctagttaagtgtttttaaacttatcttctagtcactactgacagaatttgtattcaacatcttttaagtcttccctgcgattactttcaactgtattcctcttaaaggtttctctggcaacctttaaaagtgacagagatgcacagaatctgggagatttgtacaatctcattttttaaagcaaaaaataatgcctctaggcatatggataactaatgcaaaagaaaacttgcctaaaaatgtaatttgttttcctgcttaatatgaaaaggaattttaattaaaaatatattgaatttttatcagaacttttaatttcctacaaatttaaaaatcacagtgtaaagttctagtaacttctgttgaaaaagatttggtaataaatgagcaataatgctacttttcataaatatttaaaaatatttaggaaaaatatgttaatatgtaataccccatttttttccatttccccttttatgatttatagtagcctgcaattggcagacaattaaatttatagtaaacttccaaactaaacaagagtttgcttttctgattttttaatgtgtaaatcttagctgtagggatcagataaggaaatcatattattaccccatgtattttaagaaaacagatgactaaaagtctggaagtaactactatctatatttctatctatctgtcatctttcttgtttcaaggcctcgttctagatcaagggacagtggagacgaaaatgaaccaattcaggagcgattcttcagacctcacttcttgcaggctcctggagatctgactgttcaagaaggaaaactctgcagaatggactgcaaagtaagattttgttattgcttgcatatcctattgccccacttctccctcacttgccatttctctatagttccttttggggaaattacataaagtataaaatgagagctgggcacagtggctcacacctataatcccagcactttagagtccaaagccgggcagatcgcttgatcccaggagttcaagaccagcctgggtaatatggagaaacccatctctaccaaaaatacaaaagttagccaggcgtggtggcgtgtgcctatagtcccatctacttgggaggctgagttggaaggactgcttgagcctaggagctgaagctatgtgagctatgatcgagccactgaattccagcctgggtgacagagcaagaccctgtctcaaaaaatgaaatgattctagcttaagggggggaaaaagtgaaatacgtcggatatttatatattgtttactatgattctttaaatctaaattaaatatgttctttactcagaaccctacatgacattactctagaaagtcatcaggaggttttatttatccctttaaatgttgaaataataaatatgataaatctaccatgtcttcattcttttttcatacaaattttgtatccatatatctactctgacttttattcctcccattttctaattctttttttttttttttgagacagagtctcactctgtcaccaggctggagtgcagtggtgcaatctcggctcgctgcaacctctgcctcctgggtctcctgcctcagcctcctgagtagctgcgattacaggcatgtgccaccaggcccagctaatttttgtatttttagtagagatggggtttcaccatgttggtcaggctggtctcaaactcctgacttcatgatccgcccacctcagcctcccaaagtgctgggattacaggtgtgagccacagtgccccgcccccattttctaattctaagataagttagagggacatctttctttcatctgttttgcagcagggctttttgtttttttggggtttttttttttttttttgagacggagtctccctctgttgcccaggctggagtgcagtggtgtgatctcagctcactgcagcttccacctcccaggttcaagtgattctcctgcctctgcctcctgagtagctggaagtacaggcacgcaccaccacgcccagttaattttttgtatctttagtacagacggggtttcaccatattggccaggctggtctcaaactcctgacctcgtgatccgccctcctcggccttccaaagtgctgggattacaggcatgagccaccacacccggcctacagcaaggctttttaacccaaggtccttgggtaggcaggcttcattaggtgtttgaactctgaaattacctacaaaattatgtgtgtaagataacgttcatccatttctcaaaggagtttagggaaaaaatatttaagaaacactgctctaaaattttttgtttgatttcttttttgccccctgtttactgatcttaaatttagtttaactcttaaatatggataaggttttaaaaagttatttgggctccctctgctggttctgtatggaatatgagaacacaaatataggctgcttagaggatttgggcattgtttcttcagaaagtaaatctgggattatagaaatgtataaaaagaataaatataacaaaaatattttatttcttaggatcattatttattttttacagtataaatacacaaattgtgtttcagtctgtatatattttatatatatatgagtgtgtattcatttttggtctataattaagaattatacagtacagctaccatatgatccagttaattctactagtgcttatatatccgaggaaaatgaaatcagaggctgggcacagtggcacacgcctgtaatcccagcactttgggaggctgaggcgggcggatcacgaggtcaggagtttgagaccagcctgaccaacatggtgaaaccccatctctactaaaaatgctaaaattagccaggtgtggtggcatgcatctgtagtcccagctactcagggggctgaggcaggggaatcacttgaacctgggaggcagaggttgcatcactgcattccaacctgggcaacagaacaagactccccgtctcccccacaaaaaaaaaaaaagaaaagaaaatgaaatcagtagcaatatctgcattcccatgttcattgcagcactattcataatagccaggatacgggatcagcctaagtgtcaacagatgaatgaataaagaaaatatgagatatatatatatatacatacatacacacacagtggaaaattataatcctgtcattgtgacaacatggatgaacctggaggacataatgttaagtgaaataggccaggcacagaaagataaatactacaggatcttacttatatgtgcaatataaaaaagttgaactcatagtagagaatagaatggtgattaccacgggctagacggggagagggaaagttggggaaatgttagtcaaagcatataaaatttcagacaggaagaataagttcaagagatctgttgtacaacatggtgactatagttaataacgatgtactatatacttgaaaattgctaagagtaggttttaagtgttcttactacaaaaaaaaatgaagtcatacatatgttaatcagctcagtttaggtattccacaacacatacatatttcaaaataatgtgcagaattacatacaatttttatcaattaaaaaacacttaaaaaaattcatacagaccacttgtaaaataacgttttgagttaaccagggaaattttattttaaatagataattagattataccaaagaattattaattttacgtgtaaaatggaattgtgattatggaaaagtcttgtttttagaaatgcatactgagctatatgggggtaatggtatataaaatctggaatttatttttaaatataaaaaataagagagtgactaaatgatgggtatatacacacttaccatactggttatctctatttttaatcatatttaagaaagaaataacagtactgtctttcactggactggcacataactgtccttaaaacgcctgccattaaaagaatattggaaacaaaaagtaaactgcctattgatttcactatgatgatctgacctggataaagaaaatgtgaaaaatcggccaggcacgtgggtcacgcctgtaatcctaaaactttgggaggccgaggcaggtggatcacctgaggtcaggaatccgagaccagcctggccaacatggtgaaaccccgtctctactaaaatacaaaaaaatcagccaggcatggtggcaggcgcctgtaatcccagctactcaggaggctgaggcaagagaattgcttgaacccgggaggcggaggttgcagtaagctgagattgtgcccactgcactccagcctgggcaaggagcaagactgtcttaaaaaaaaaaaaaaagtgaaaaaccttgccacatgtacagatagatcaggaaaaaaaaaaagttagtgtatttaagctttgaaaggggaaaaaatcctgacgataagccaaacactaaagcagcagcttgcttttcctccaaaaagccccctccccttttagcccctgaggaacattcctagacactgattatccttaactggtactaaattttcaggaaaataactaattccactcccatagcaacaagcatcactattttcatgtgtgctgagagtacagatctagttacattgtgacctgctggtggtgaccttcagctcctgagatcatgctgtctttacttagccaggagaactggggttagaaaaaaggtacaaggggcattctctttgccctagcatgagtaactatccactgggtaggttcactgtgaatcacgtggtttgagagtacgcgtgctttgggcatctctcctactaaacatactgtggcttcagtcagtagatggcttatctaggatctaacctggtaaagtaggaacaagcagtgccgctttgtttctagatgtgggaacaacaaggagcctgaccaaagatgtccactccctcttcctccacaccacttctgatgacctccaaacaggtcaggcagtgtacatggagagctggggacagcaagtggatagataggagaacacagagcctgagtgtctcagaagccaagctgcctaactactgctgtttgtttccaaaacctcttcatccttttaaccagtcatttaagtttactttaaatgctgtagccctttgctacatgtgtggtgggaggcatcttgcaggtaatatcagttgagtatcacgtagcaggaatggaatttgtgagtcctctggctgatgctggcaaagctagttcttcaaaagaactgttttacagtctaagtgacatctttttgtatataacttcgtactagtaaagttgggggtagggggtaaaaaggccttccttaacagtgcatttcttccattcaaaatcaagggcaaaactaaaaagctggcagatggcgaccatcctgaccctttgcggcacaacatgttattagcaattaaatgcttttatctgatctctggtccacacaactgtcaaggtctcaagattttatgatgtttccattgtgatggtaatttgttgagatggctttctgggtaatttcgtattgctcttgttattcagtttcaaggattataaaataataatagcagccctgtgtgctgacgaatgcattctccataactatggctgctccttgatgagaagctttacagtactatatataaatgccagctgagtatttgttattattgttggacatcttttttcaaagaagcccagagcctggtgctgatatcatcccattaatctccatagccctgggcaaggtaagaccatgacagcaattttttaaatcccatctcggtcttctctaggttgctctgtaagaattgtttagatgtaagctggtgagtgctcaggaagccaaagtttaaagcaaaagttttaagcaaaagagtaacatgagctgatactaaaagccatctcttggcccggtgcaatggctcatgcttgtaatcccagcactttgggaggctgaggcaggcggatcacctgaggtcaggagttcaagaccagcccggccaacatagtgaaaccctatctctactgaaaatactaaaaattaggctggcatagtggcaggcatctgtaatcccagctactcaggaggctgagacaggagaatcgcttgaacccgggaggcagaggttgcagtgagctgagattgtgccactgcactccagcctgggcaataagagtgaaactctgtccaaaaaaaaaaaaaaaaaaaagccacctcttgtactactgaaggaggaatttatgcagacttcttagctaccagtgatttcactctgttttaatacaaaaatttacatgtatttcttttatgatttaggtcagtgggttaccaaccccagatctaagctggcaactagatggaaagcccgtacgccctgacagtgctcacaagatgctggtgcgtgagaacggggtgcactctctgatcatagagccagtcacgtcacgtgatgccggcatctacacatgtatagctaccaaccgagcaggacagaactcattcagcctggagcttgtggttgctggtaggctcatctgtgaatccttgctctctgacagaatgaacatcagacttacaaatgtaaactaattctacattactaaccaatacggaaaataaagtattgaaaaaatagattgtatcatcaaaatagccaatgaggacatggttataaggcctagcaaaacagaaacagaaatctttcatttctcccactaacctggcaaagagagaaaaagattttattagctcttttgggtcattcgacctcctgtgtgtatagtggcccctagtgttacatagagaaatagtaacagcagcatggactccaagaaccaaagaatttgcttatatataaagttttatatttatatatatatatatatacacacacacacacacacacacacacacacacacacacacacctggtttttaaaacaacactgtcatctaccctcatagtcattgtcaaactacactcagatttgctttttcactgattattgtgtaggtaaattctgtaaaagtgctgttacatgaagtcttatgctttgagaagcctaaaaggaaaacacatttatggaaaggtttttataccatccttaagagttaggtgttgagtacctgatctcttttaagaaagaacataacaaaacatttatttcttctacctctttatgcaaagtgcttcatgtacattatgtatcagttggccctcacatgagccttatgagataatcagagcaaatcttctctgaattttccagggtcccacttagtaagctgatgattagatttaacacaagactcctagtgctcttctaaacacactacgtcactgagctctttcaagaaatagagtagcaatgagaataaaacccaagaagtcttgacaaaactcttggattatgattctgataatggtaccaagatgttttcacataaaaatgtggtaaatatgtggactgtggtgctacaggttagccatgctttcaagttttgtacaaagtactctatattcttacatgctacaattgatttcattcctctaacctcaaactaaaacttcacttttctgctgttaaatatgccttttgatcacatagatacctcagtgcgcatcagctggcactcctgtcagaagacggtgatgcacagtaattggaagcaaagtctttggggtcagatctgctccagtcccggctcttgtcgattttactagtgtgacatttggcaaatagctatctctgcgacttagtttctccatatataaaatgggaatataatgcctcacagtgctttcctaaggattaaatcataaaaatgtgtatgaagctctgcataactagtaccctgcacagcaatgctgcaaagtggtagatgttattcttactgatgagttgctatgacattaagacttgttttatacattttatgttctttgcaaaactggagccccagaaagaatacaaagtgagcttctgttcccacttctcccagaatagcctaggatgggcaaccatgtaaaattcaataaaaatccaaccttctaactaactcgtggtgttggagagtattaagcatttgaaaagttcaggtagaattttcatcctttttgagctctttcctagctgctttgctgtgatatatctgtcactccagatgagggagtagtggtggaaaaggaatgcattctcagattcattgttggtagttcaaaagaaaataagtaaaccttattcattctctgaagtactttccaccactactacaactgatccaagaaaacaatttcccattggatggtattattcagagtgttattaacaatcagtcctgaatttttcagaatagtactaaagttgtcttttttttttaatgggttccttccttcaaggttataataaagcttttttataaccttcaaagaatacaaagtggaatttgtaatttataggatatacattcctagtttacaggtaactatttaaagctgccaaatttagataaagatgcctcccctttaaattgccccctttaaattctatggcatgtctcacttaagagttacaaatattcagaatattcatggcaaacatggcaaacggcagtgagggaatctaagtggtcaaattcctagaaatacttgtcctcagcaccactaggtggcagtagttggttgaggctgtgaatgatcggtaacataatcactagtagtgaagccatcacagatgctagcaatgacttaggagtctcccacagctggtcagacaggcattctgtgaagcagatggccagtggacagtgtgagcctatcagacttgaattaattgaggaaataaatgagcggaatgaagtatacagacctttgcttggtaaaagaataatttggagaggggactagcatcttaccacctggagtaaaaaatggtatcataaaagatctattcaagcaatattccaaaagccttctgaattctttctagtgctccttttgtatatcattgatagagaattcatctcatgttttcttagctaaagaagcacacaaaccccctgtgtttattgagaagctccaaaacacaggagttgctgatgggtacccagtgcggctggaatgtcgtgtattgggagtgccaccacctcagatattttggaagaaagaaaatgaatcactcactcacagcactgaccgagtgaggtaagactgcacaatgagaacctgatccttaactgttcagtcctaatgatgtatcaaaagatacattttatatagcatggaaatctatgtgtaaaagccacatagatgttttgatttttgatgaaatcaatcaaagacaaaaaccatgcgttacccaatgtaggattaagcttttagaaggaagctatgggtgtttgatctaatggtgatttcttaaaagtgtttatcattctatctaaaagaaaagatgaattcatttgctttagtgataaaagactattcagtggtttttgtaaaggcagatcctcaactaggaattaagcacacagatgtattcaactcttgacgtctgttctttctcccattaactttaatggagctagtaatctctacagaataagtatgaccctattatcagctacttgcacaattctgtttctaatgatctaattaaaaatgatgcttcatgtccaaagccacttttaaaaaatttagaaccctaatgactttatccttttctccagcatgcaccaggacaaccacggctacatctgcctgctcattcagggagccacaaaagaagatgctgggtggtatactgtgtcagccaagaatgaagcagggattgtgtcctgtactgccaggctggacgtttacagtgagtgccacttcatctcatttcattgcgtttactcattaaattatgaaaaattagacatctggacagcaaatcacattactctttataaacaactattgtgttttatttgtcaaaaaaattcatattgctctctctctctttctatttgtagtttctcgacattaatagtgaaccacaccaggagaacaaatacccaagtatcattcaggaactttgaattattagcaaaatatgcatgttgatttctcttacattggctagttagttgtggcttccttactcaagcatccttaggagttaacagtaggcaaaggcataaccatgtttttcacatgttcttgttactgtgttctgcaaatgactgccttttaacatttcttcctatattctatcgcagtgtcctaatgcactctaaacgtgtgttccattgatcctggaatgcgtacttttgtggcttagtgcttttctcattaatatatcttaagcagccagcagtagacttgtgtttgtatatttgtgtacatgcatcccaaatttaaagaaaattattcctattgaatttacagtctagtacaatcagcattatgttatccattgacataaaaaaaacactagaaaaaaattaagaatttatttaagaatttatttcagattttgcctcttcttgaaataactatgtgagggtcatcaagaaatgtgtggcctcaaccttccctactgtacgattcctttcagttgattagtgttaaagcatccacatccagcagaattcctaagtgctataattattttagagaaaatattttttaaaaggagaggggggatgagaattaggaagcttatcagctattccaaaggattccctgtgctgcagtgtttacttaaaaaaaaaaaagataaactacacttgacctttgtaatctagctgctttattcccactatcctgtatagacagtaaatctgcaacatgtgagtaaaatgcaaaagtgttcctaaattttccatgtttctaccatggatgtgttcaggtgccttgcatctatctagacattctgtatttatttgaaatatctaaaggctttccaagtatatcttgattaaaaatcttaatttactctttttctttgtagcccagtggcatcagcagtcacagagcaccaagccaaaaaaagtacggccctcagccagtcgctatgcagcactttcggaccagggactagacatcaaagcagcgttccaacctgaggccaacccatctcacctgacactgaatactgccttggtagaaagtgaggacctgtaatccagcattcttgttaaagctgaaacactgaaacagccattgccttgaccaacatattcctttgtcacattatgtaaaaggcagaaacatacctttgactataagaaattaaaaaaaaaacaccaaaataatatttttcttacttgatataccaaacttagtttaagtagataatgctaatacaaatatacacattgcacagaaaatacacatttactgtccaatttaaaactttggaattgctgtgattaaagtgatcaaaatgccaaaatactaaaggaaatcaattgttcacaggtaactacaatttgtattatctacaagtgcctttaaacacaagatataggtgctgtgtagcctgatagtgtgaaatgtttaatgagggagttgtaccacaaacagtactacaatgattctgaagcacagtgtattcagacagatacagtgaaccaagtgcaatatgtaaggatgaaagaagaagagatgacaaagaaatccaagtaaatgccttgtctttgcaaatgtttttatattaaatcataaggaaggaactacttgccttaaatgttaatatcaaaagagttttctaacaaggttaataccttagttcttaacattttttttctttatgtgtagtgttttcatgctaccttggtaggaaacttatttacaaaccatattaaaaggctaatttaaatataaataatataaagtgctctgaataaagcagaaatatattacagttcattccacagaaagcatccaaaccacccaaatgaccaaggcatatatagtatttggaggaatcaggggtttggaaggagtagggaggagaatgaaggaaaatgcaaccagcatgattatagtgtgttcatttagataaaagtagaaggcacaggagaggtagcaaaggccaggcttttctttggttttcttcaaacataggtgaaaaaaacactgccattcacaagtcaaggaacccagggccagctggaagtgtggagcacacatgctgtggagcacacatgctgtggagattgcagtgtgtctgaggtttgtgtagtagtggaagattttaggtatgtagagcaagttgaaaatggattgagactgcatggtggcataaatgagaaattgcctgtagcatctagtctacttgaaggaagtggagacataaggagagacaaaaacaggtttgtgccataaagtattttttcaaagacaccaagatgtggtaaatgaaaattattagttcacttccctgctgccatgaaactttgccttaagaaggtgctggattccaaggtttgtaaaggcatctcggtaaagactgctttttgaatgcatatgattttgcatcagctagactgagttgattctgaccagacttgatggttttaagtcggaaccgataaattttaaaaaggagaaaaaataatttgacctagtagtataaaacatgaggctttaatggtactttgctatgaaaagaaaacactgtattccttatgcaaaacacatgtatctttcattatttataagtggcctctcttagctcagttactcaattcatacgtagtattttttaaaataattttatatctgtgtaccaccccatatatttcatattactgtttcacatgtacagctttctacttctttgtaagaacaccaaccaaccaaggtttaagtgattaataggcttgagcaccgggtggcagatgttctatgcagtgtggttcaagtttctttgaccgcacttatatgcattgctaatatggaatttaagataccatacacagtctctcatggacctatctctattgtagaattatgacttatgtcttacttgccaaatttttctgaatgtgacctttttttgctgatttgctgggtttgggattaactagcattattttgccacctttatattgtatttataaaaaaaaaagtactatcaatcaatcatactactttggattgttgtgctggtgtaatgtggatttaacatcaataaatatttgacaaataatagttgcagttttgtgaagcaaaataaatattcagttttagttttctgttgctgccataacaattagcataaactttgagtgatgtttgaggcttcagcatcactcatttattactcacagttctgtaaatcaagttcgggcaggatgtagctgggttctctgttcaggatcttataaagctaaaatcattgtatcagctggactgtattctcatctggagctcaagatcctcttcaaaattcaagtggttgtgatagctctgtgcaattgtagaagagacgtctcctttagtccctcagccaggagctctctctctcagctcctgaaggccgcctgtattccttgccatgtagcccgctccatcttcagggttagtggtgagaatctccttcacctcagatccctctcacactttctctttgtcaaaggcccagtcccttttaaattacgtcaggcccatccagataatctccctttcttaaagtcacctgactttgggaaccttaattacatctgcaaatcccttcaaagcagcagctaaatcgccatttgattggaataactgagagaaggtgtgtatacaccagaggatggggatattaggggccatcttacagttctgcctgccacagcaatgtactgtaggtatgcatgtaaatacacaccagtgccatgacgtacaaggatacataaaatacagcaagatgatataaattaaaagtgaggggaaaaggaagaaagtaagtataaatggaacaaggaatgagatattacacacacacacacacccatattcatatacacatatagcattaatatctacatagttacaacagacggacaacatatttgggcctaggctttcctactacgggaaagagaaagctggtcatttatctaattcacagcctccataaggtgaaaatatttcatcttttacatatgcaatataatggagctttgaggatacatttgaattagactagaattgtgtatttcacattgtcttctataccccatgacttgctatgtagtttacaagattcattatatattttaatgctgaatttgtccttgattttcccttttatgaacatgcataacatgacaatccccttggcttgctcagtagctacaacctcctttatcatcatgtaaatttagtttgacccctttaaattatagaaatacaacttctatattatggtggtgaggaacttgagtgttggagttggccaaccaggatttgaatcctagctcttttgatcatgtgtgacccataagcaagttactttacctccccaagcctcagtttccttatttggaaaatggagattaaaatagcacccctctctttgtgctgctgtgaagattatatgggatgataattttgacatggtacctggcacatagtaagagctcaataaatttcagctattattttagtgtagttggaaactaaagtaaaatttcaattacaaaatgtgtacacacctaacaaaattccacagatggttaaaatttgtgaacttggatgggaaaaacattaccccctagctgaaatttagaatttccttcaattatgaatgtaggcaacaaaacacaacagtataaaatacctgggactgtcctagtaaaaattatattacaaatattgaaatatcttaaaatccatctaaattcagcattacttcaaaattatggcagttgttagagttaccaatagatgtaatttataggcatttgtattataaatttgtttttaatactttgataattacttaaaaataatttgttttatgtattttatgcctccatgaacattattttgagaagggatccagaagatttaccagagggtcaaaaaggcatatggcaccaaaaaaattaagaaccaggccctacagaagcttaaatacgtagaaaaggataaaaaatttgaggaaagcctaatttgtcattagtagaagaaggaacaaaactaattaattcatacaatgaaatattacttactattcagagttaaaggtaaagaaatggatttacttctattggcagggataaatatgaaaaacagcatttgacgaggaagggaagttacataagagtgatgtcagcaagatggctgactagaggttcctggcattcatccccccaagaaaggatcaacaaatgaacaaacagttaacattcaactgaagtgtcaaaggaagagcactggagtgcagtgggggtagctgcggtcactgaaagtccagaaggcagcatggagacaccttgtctctgctgcccatgcccctgcatcccccaactctgactggcctggagtcaagaggagaaactttcctttgctgggaaaacgtaagcagagccccatcagcccccattaccactgcaaacacctacaatccttactacaggagaattccacagtcctcacaagccctgaaccgactttagagagccactgtcgattgcacagctgcattcctctggattaggaacatgagatatgtactctccaccccttaggtgcctgctgtggggcccagtagcaaatgcacctctccagcccagcggctctgtcattccaccaagcacacatgggtggctgcaatgccacaaccctggaggctcagaacctgggcccaggattggctgtgactctggttctgcacagcaggaaaaccaaccatcattgcctgaacttccaggcagagaaacagtctagcaaattctcccaaagcatacatacctacccttgagctggccaaactgggcccctgagctgctaagcacctgacatgccctcaggccagaaccagtaccagcctatctcctaagcctgagaaacagcccaatgccccctacctccatggacatgcctccaggcctacccagtggaactgtgcccaggctagggtatgagaaacagtccagtgggcccaatcccagcatacatgtccctagaccttcccagcagccctgtgcccatgcccagggcctgagaaacagcttgggagattaacttccagtagacacacccctgggccaggtgagctgtcacatgaccatgcccagggcctaagaaagagccccatggggtcaacccccatggacacaccccctggctggctgagaggcacaccactgtcccaagcccaagaaacagcccacttggcccacctctggcagacacacccccaggccaaatgagcatgcctgtacccagggcctgagaaacatccctgtggccccaatcccagcaagcaagaccccaagttggttgacaccgttcacacacatgcccccaatttgagaaacaatccagtgagcccaccccagcaaagctgcaccaccactgctacaaattctcacagcctaggccactgggcacttacaaacatcagcagactggattacagctgaagaatctgcacagacactacagtactgcatccacctagaaccaaagccaacacaccccccctaactgacactataagatcctccaatacaaatacgtctttccctacaaaacctttcatcaaattagaagaggtgactgttctaccagatgcatagaaatcaacatcaaggaacatatcaaacatgaaaaaacaagaaaccatgatacctccaaaagaacacaataatgctccagtaacacaccttaatcataaggaaatatgtgaaatgccataaaaagaattgaaaataataatcttaaggaagctcagtgaggtaaagagaatatagctaaactgttccctcaaatcaggaaagtaattcatgatttgaatgagaaattcaacaaagaacataaaaaaaaaaaacccaacagaaatcttagagttgaagaattcaatgaataaaataaaaaatgcaatcaagagcttcaacaacagattagacaaagcaggggaaagaatttctgaacttggaggtaggccttttgaaataactcatgcagacaaaaaaaaaagaataaagaaagcctacagaatgtatgggacactgttaagtgaacaaatatttgcattttggaactccagatggagaagagaaggaaaaaggtatagaaaacagatttaatgaaatcacagcaaaaaacttcccaagttttggaaaagagatgaacatctagctctaagaagcttaaagtccccaaagagattcaacctaaacagttcctctctgaggcacattatagtcaaattgtcaaaagtcaaatacaaagaaagaattctaacaacagcaagagaaaaacgtcaagtcacatataagggaatacccattaggccaacagcagatagcagaaaccttacaggccgggaaaaaaagaaataatatattcaatgtactaaaagaaaaatattgccagtaaagaatattgctttaatattctttattaaatataagcaaagctattcctcagaaatgaaagaaaataaagtctttttcagatatgcaaaagctaagggaagactagccttacaagaaacactcaagagagttttagatctggaagtgaaaagacaataaccaccaccatgatgaaaacaaatgaaattataaaattcacttgtagagctgatatacaaaagagaaagagaaaggaatcaaaccttatcactacagaaaaccactaagccacaaaaataaacaataaggaggattaaagagaaaggaatatacaaccggaaaaccatcaataaaacgacaagagttaagtcctcacctaccaataaataaccttgaatgtaaataaattaaattccccaattaaaagacgttgaatgaatgaatgaataaaaaaaccatgcaactatatgctgccaaataaaaactcacctcacctgtaaaagacacacaaagactgaaagtgaagggatggaaaaaaataatcaatgcaaacagaaacaaaaagtgagcagaagtagctattcttatgtcagataatacaggctatttaagtaaaaagtgatagagacaaagaaggacattatataataataaaggtatcaattcagcaagaagacataacaatggtaaatatatatgcacccaacactgaagcacccagatatataaagcaaatattattagatctaaaaggagagatagacctcaataaaataacagttgggaactttaacaccccactttcagcactggacagatcatctagacagaaaatcaacaaagaaacattggatttaaactgtactacagactaaatggacctaacagacacctacagaacatttcacccaacagcaatagaatacacattctttttatcagcacatggaacattctacaggattgaccatatattaggacacaaaccaagctcaaaaaatttttaaacactgaaatcatatcaagtgtcctatctgaccacaatggaataaaactggaaatcaataacaagaagaatattcaaaactgtacaaatacatggaaattaaacaacatgctcctgactgaccaatggatgaaggaagaaattaagaagtaaattttaaaattccttgaaacaaatgaaaacagaaacacaacataccaaaccctgtgtgatacagcaaaagcatgattaagagaagtttacagcaataaacatctatatcaaaaaagtaaaaagagttctaataaccgaatgattcatcttaagaatctaggaaaaaactgggcatagtggtgcacacctatagccccagccactcagaaggctcgggccaggttgctttgaggccaggaatttgagactacagcacactccaatttggcctgtgaaaagccactggcaagacccagtctccaaaacaagttttaaaagaaactagaaaagcaaaaaaaacaaaaaaaaaaaaaaaaaaaaaagcaagccaaacccaaaattagcagaaggaaagaaataataaagattagagtagaattaaacaaaattgagatttaaaaatacaaaagatcaacaaaaagttggttttttgaaaaaataaacaaaatcaactagccactagactaagaatacagagagaagacccaaataaacaaaatcaaaaacaaaaaaggagctgtcacaactgatactacagaaacacacaggatcattagaatctatcatgaacaaccatatgccaataaatttaaaaacctagaggaaatggataaattcctggacacacaagctaccaagactgaaccaaaaagaaacagcctgaacagatcaataaaaagtaatgataataaatcagtaataaaaagcctcccaacaaggaaaaaaccaggactggatggcttctcagctaaattctaccaaacattaaaaaagaaagaaaaaaaactgccaattcttctcaaactattccaaaaattgaagagaagggaattcttccaaacttattttacagggccagcataattttgacaccaaaaccagataaggacataacaaaaaaacaaaactacagaccaatatccctaatgaacatacatgcaaaaatcctcaatataatattagtaaattcaatctaacatcacatcagaaagatcatacaccgaagatggccaaatgggaacagctccggtctgcaacccccagcaagatcaatgcagaaggcaggtgatttcttcatttccagctgaggtacccagctcatctcattgggactggttagatagtgggtgcagcccatggagggcgagcagaagcagggtggggtgtcacctcacatgggaagtgcaaggggtggaggaactccctcccctagccaagggaagccgtgagggactgtgccatgagggacggtgcattccaggccagataccacgcttttcccacggtttttgcaaccatagaccagatgcctgtgccaccaaggccctgagttttaagcacaaaactgggcagccatttggccagacactgagctagctgcaggagtttcttttcgtaccccagtgactcctggaacaccagcgagacagaaccattcactccctggaaagggggctcaagctagggagccaagtggtctagctcagtggatctgaccccctatggagcccagcaagctaagatccactggcttgaaattctcactgccaccaagcattctgaagtcgacctgggacaccccagcttggtgagggaggggtgtctgccattactgaggcttgagtaggcagttatcccctcacggtataaaaaaaagcctccaggaaatttgaaatgggcagagcccaccacagcttggcaaagccactgtagccagactgcctctctagattcctcctctctgggcagggaatctctgaaagaaaggcagcagtcccagtcaggggctcatagggaaaactcccatctccctgagacacagcacctgggggaaggggtggcggtgggtgcagcttcagcagacttaaacattcctgcctgccagctctgaagagagcagcagatcttgcagcacagtgctcaagctctgctaagggacagactgcctcctcaagtgggtccctgacccccatgcctcctgactgggagacacctcctgactgggagacgcctcccagcaggggtcgacagacatctcatacaggacagctccagctggcatctggtgggtgcccctctgggacaaagcttccagaggaaagaacaggcagcaatctttgctgttctgcagcctccgctggtgatacccaggtaaacagggtctggagtggacctccagcaaactccagcagacctgcagtagagggccctgactgttagaaggaaaactaacaaacagaaaggaatagattcaacatcaacaaaaaggatgtccacaccaaaaccccatttgaaagtcaccaacatcaaataccaaaggtagataaatccacgaagatggggagaaaccaatgcaaaagggctgaaaattgcaaaaatgagaatgcctcttctcctccaaaggatcacaactcctcaccagcaagggaacaaaactggacagagaatgagtttgacgaactgacagaagtaggcttcagaaggtggataataacaaactcctccgagctgaaggagcacgttctaacccaatgcaaggaagctaagaagcttgaaaaaaggttagatgcattgctaactagaataaccagtttagagaagaacataaatgacctgatggagctgaaaaacacagcacgagaacttcgtgaagtatacaaaagtatcaacagctgaatcgatcaagtggaagacaggatatcagagattgaagatcaacttaacgaaataaagcatgaagacaagattagagaaaaaagaatgaaaaggaatgaacaaagcctccaagaattagggaactaatgtgaaaagtccaaacctacgtttgactagtgcacctgaaagtgacggggagaatggaaccaagttggaaaacactcttcaggatattatcaaggagaacttccccaacctagcaagataggccaacattcaaattcaggaaatacagagaaaacaaagatactcctcgagaagagcaaccccaagattcataatcatcaaattcaccaaggttgaagaaatgaaggaaaaaatgttatcggcagccagagagaaagatcctcctttggaggatcacaaaaggtcaggttacccacaagaggaagcccatcagactaacagcagatctctctgcagaaaccctacaagccagaaaagagtggggaccaatattcaacattcttaaagagaagacttttcaacccagaatttcatatccaaccaaactaagcttcataagcgaaggagaaataaaatcctttacacacaagcaaatgctaagagattttgtcatcaccaggcctgacttacaagagctcctgaaggaagcactaaacatggaaaggaacaattggtcccagcaactgcaaaaacataccaaactgtaaagaccatcaacactatgaagaaactgcatcaactaacgggcaaaataaccagctagcatcataatgacaggatcaaattcacacataataatattaaccttaaatgtaaatggactaaatgccccaattaaaagacacagactggcaaactggataaagaatcaagacccatcggtgtcctatattcaggagacccatctcacgtgcaaagacacacataggctcaaaataaatggaagaatatttaccaagcaaataaaaaaagcaaaaaaaaaaaaaagtggttgcaatcctagtctctgataaaacagactttaaaccaacaaagatcaaaagagacaaagaacggcattacataatggtaaagggatcaatgcaacaagaagagctaactatcctaaatatatatgcacccaatacaggaacatccagattcataaagcaagttcttagagacctacaaagagacttagactcccacacaataatagtgggagactttaacaccccactgtcaataccagacagatcaacaagacagaaaattaacaaggatattcaggactggagctcagctctgcaccaagtaaacctaacagacatctacagaactctccaccccaaatcaacagaatatacattcttctcagcaccatatcacagttattctaaaatttatcacataattggaagtaaaacactcttaggcaaatgcaaaagaatggaaatcataacaaacagtctgtcagaccacagtgcaatctaattagaatttaggattaagaaactcactcaaaaccacgtaattacatagaaactgaacaacctgctcctgaatgactactgggtaaataacaaaattaaggcagaaataaataagttctttgaaactaacgagaacaaagacacaatgtaccagaatctctgggacacagctaaagcagtatttagagggaaatttatagcactaaatgcccacaagagaaagcaggaaagatctaaaatcaacactctaacatccctatgaaaagaactacagaagcaagcacaaataaattcaaaagctagcagaagacaagaaataactaagatcagagcagaattgaaggagatagagacacgaaaaatccttcaaaaaatcaatgaatccagaagctggttttttgacaagatcaacaaaatagaccactagccaggctactaaagaagaaaaaagagaagaatcaaataaacgcaataaaaaatgacacaggggatatcaccaccaatcccacagaaatacaaactaccatcagggaatcctataaaaacctctatgcaaataaactagaaaatctagaagaaatggataaattcctggacacataaaccctcccaagactaaatcaggaagaatagaccaataacaagttctaaagttgaggcagtaattaatagcctaacaaccaaaaaaagtccaggactagacggattcacagccaaattctaccagaggtacaaagaagaactggtaccattccttctgaaactattctaaacaatagtaaaaaagggaatcctccctaactcattttatgaggccagcatcatcctgataccaaaacctggcagagacaaaacaaaaaaaagaaaatttcaggccgatatccctgatgaacatcgttgcaaaaatcctcaataaaatactggcagacagaatccagcagcacatcaaaaagcttatctaccacgatcaagtcgacttcatccatgggatgcaaggctgcttcaacatatgcaaatcaataaacgtaatccatcacataaacagaatcaatgacaaaaaccacatgattatctcaacagatgcagaaaaggcctctgacaaaattcaacaccccttcatgcaaaaaactctcaataaactaggtagtgatggaatgtatctcaaaataataagagctatttatgacaaacccacagccaatatcatactgaacgggaaaaagctggaagcattccctttgaaaaccggcacaagacaagaacgcccactctcaccactccaattcaacatagtactggaagttctggacagggcaatcaggcaagagaaagaaataaagggtattcaaataggaagagaggaagtcaaattttctgtttgcagatgacatgattgcatatatagaaaaccccattatctcagtccaaactcttcttaagctgataagcaacgtcagcaaagtctcaggatacaaaatcagtgagcaaaaatcacaagcattcctatacaccaataacagagagccaagacgtgagtgaactcccatttgcaattgctacaaagagaataaaatacttaggaacccaacttacaagggatgtgaaggatctcttcaaggagaactacaaaccactgctcaacgaaataagagaggacacaaacagatggaaaaacattccatgctcatggataggaagaatcaatatcatgaaaatggccatactgcccaaactaatttatagattcaatgctatccccatcaagctaccactgactttcttcacagaattagaaaaaactactttaaatttcatatggaaccaaaaaaagagcccgcatagacaagacaatcctaagcaaaaagaataaagctggaggcatcatgctacctgacttcaaactatactataatgctacagtaataaaaacagtctggtactggtaccaaaacagatatatagaccaatggaacagaacagaggcctcagaaataacaccacatatctataaccatctgatctttgacaaacctgactaaaacaaacaatggggaaagaattccttatttaatacatgctgctgggaaaactggctagccatatgcagaaaactgaaactgaaccccttccttacaccttatacaaaaattaactcaagaggaattaaagactgaaatgtaagacctaaaaccataaaaaccctagaaggaaacctaggcaataccattcaggacacaggcatgggcaaagacttcattactaaaataccaaaagcaatggcaacaaaagccaaaattgacaaatgggatctaattaaactaaatagcttctgcacagcaaaataaactatcatcagagtgaacaggcaacctacagaataggagaaaatctttgcaatctacccatctgacaaagggctaatgtccagaatctacaaagaacttaaacaaatttacaagaaaaaaaaaacatcaaaaagtgggtgaagaatatgaacagacacttctcaaaagaagacatttatgcagccaacaaacatatgtaaaaaagctcatcatcactggtcattagagaaatgcaaatcaaaaccacaatgagatatctcatgccagttaaaatggcaatcattaaaagtcaggaaacaacagatgctggagaggatgtggagaaataggaacacttttacactgttggtgggagtgtaaattagttcaaccattgtggaagacagtgtggcgattcctcaaggatctagaaccagaaataccatttggcccagcaatcccattactgggcatatacccaaaggattataaatcattctactataaagacaacgcacacgtatgtatactgcagcactgttcacaatagcaaagactaggaaccaacccaaatgaccatcaatgatagctggaaaccatcattctcagcaaactaacacaataacagaaaaccaaacaccacatgttctcactcataagtgggagttgaaaacacatagacacagggaggggaacatcacacaccacagcctgtcgggggtgggggcctggggaagggatagcattaggagaaagacctaatgtaaatgaccaattgatgggtgcagcaaaccaccacaacacatgtatacctatgtaacaaacctgcacgttctgatgtatcccagaatttaaagtacaataaaaaaatttttttaaaaagattatacaccatgatcaagtaggatatatcccaaggatacaaagatggttcagtatatgcaaatcagtaaacatgatacatcacattgacaaaataaaggacaaaaaccatatgatcctctcaacagatacggaaaaagcatttggtaaaattcaacatccctctacacaaacatcaactaaaatggatcaaattcaacatcaaaatcctaactgaaaaataaaaaaagatacatacccagtaatgggattgctgggtcaaatggaatttctggttctagatccttaaggaatcaccacactgtcttgcacaatgattgaactaatttacactcccaccaacagcgtaaaagccttcctatttctccacagtcgccccagcatctgttgttccccgactttttaataatgccattctaaatggcataagatggtatctcactggggttttgatttgcatttctctaatgaccagtgatgatgagcttttttatatagttagttggccacataaatgttttcttttgagaagtgtctgttcatatccttcaaaggattataaatcattctactataaagacacatgcacatgtatgtttactgcagccgtatttacagtagcaaagacttgggaaccaacccaaatgcccataaatgatagactcgataaagaaaatgtggcacatatataccatagaatactatgcagccataaaaaagaatgagttcatgtcctttgcagggacatggatgaagctggaagccatcattctcagcaaactaacacaggaacagaaaaccaaacaccacatgttctcactcacaaatgggagtcgaacaataagaactcatggacacagggaggggaacatcacaaaccagggcctgttggggggtggggagcaaggggagggagagcattagaacaaatacctaatgcatgaggggcttaaaacctagatgatgggttgataggtgcagcaaaccaccatggcacatgtatacctatgtaataaacttgcacgttctgcacatgtaatcccagaatttaaagtacaatttaaaaaaaaagaaaaagaaaacaaagaaaaaagaaattttaaaattccacattcaaatcctaattgaaaaagaaaaaataatggatcaaaggcctaaatgtaggactcaaaattacaaaacaactagaagaaaacattgagaagatgcttcaggacattggtctagaaaaagattttatgagtaagacctcaaaagcacaggaaactaaaatataaataaatattattaaatcaaaccaaaagcttgcgcacggcaaaggaaataatcaacacagtgaacagacaacctacacaatggaagaaaatatctgcaaactcttcacctgacaggggattaatatccagaatatgcaaagaattcaaacatttcaacagcaaaaatattttttattaaaaaataggcaagggatctgaacggatatttcacaaaagaagacatagaaatgaccaactaatatatgaaaaaattctcaacatcactaatcaaggaaatgaaaatcaaaaccataatgaaatatcatctcatcctagttagaatggctattaacaaaaagaaaaaataataataagttctgccaagaaggtagagaaacaggaactcatgcactgttggtgggaatgtagactagcacaacctctatggagtacagtatggagattcctcaaaaaactacaaagagaactaccatacgattaagcaatcctaccagtggacatttatccaaaagaaaggaaatcaatatatcagagatatctgcaccctactgacaatagtgccacctataggcctgaaggtcaaactacacaacccaatacaaagccgctgacaaaagggtacagcactggagaatgagacaagcttcctgagacctctgcaaccccagccctgtagaaggtagtgagccagctcatacacccagtacatcactactacaactggcatttgagaaagccaccgcacaaaggctatcaataaccaaggaactcatacagggtcctttccactgaaagcacccaggagcaaagccaaatgaccatactcaacatacattatagtcatgcttgagaaagctaactcagccattggtaagttgagcagagctctaaaaggtcctccataatcttttacatcataaccatcaaaatatgccgggagtgaacaacttccagcccaagtatcagagagaagttgaacatgtgaatggggaactaaacaaccactacaggctgggcatggtggctcatgcctgtaattccaacactttgggaggctgagacgggtggatcacctgaggtcaggagttcaagactagtttggccaacatggtgaaaccccatctctactaaaaatacaaaaattagttgggcatagtggcacgcacctgtagtcccagctactcaggaagctgaagtaggaggatcgcttgaacccgagaggtgggggctgcagtgagccgagacggagctactgcactccagcctgggtgaaagagggaaactctgtctcaaaacaaaacaaaacaaaaacaaaaaacaaaacgcctctgataatgcaataccattttacaagaatatgacagaaagtattgaacagggagactctacaagatttcaagcaatcaaaggctaataaatgctttttagtactttttaaatttataaaatgttgactttcccttttgaaaaagtatcttaattattttagcaaacactaaaatacttctatttttatgagttcactcataaagttttgagtttttacctgagtgtagtggttcacacctgtaatcctaccactttgggaggccgaagtgggaggatggcttgaagccaggagtttgagaccagcttaggcaatgtagtgagaccccccatctctaaaaataaagaaataaataaaataaaataaaaaataaataaattagccaggcgtgggcctggtggtgctgcttgtagtcccagctattcaggaggctatggcagaaggattgcttgagcccaggagtttgaagttacaatgagccatgatcacatcactacactccagcctgggagacaaagtgagaccctgcctctaaaaagaaaagaagaaaatttaaaaaaaagagagaaaagaaaagaaaaaagttttatgagtttactctcaatctgagtcgcgcaaccttatttttcttatgagatcttaagttcctcaaccataagggatagtttaataatgaatttagacaatatatacattttcataaactgtatttcttcaaaagaaaagaacatggaagaatttaataggaaaaaaagtgtcacagataattcttttcgtgtttataaagaattggacaagatgatgtttaatgccaacatgcctctaaagtgcaatggaatttatgtgtattcatttatattcctatgtggtctagttttcaattgtttcttactgactctcataaatacagcctgtcaagcaaataaaaccagaaatatcaatcataaacttgtgctgttcagagcatgtgacatttcatgacttcatttgtagcatgtgacattttgttttattcatattctctgttaaaaccttatctaattaaagagtttgcctacttcactagaaataactgtgttagacaataaccattctttcactaaattccttcttttggaaagttttaaggttagctcctgtatacagcagtactccaagtgtgacccccagtctatcaggaacttcctagaaatgcaaattcctgaacactaccccaaacctactgaatcagaacctcttgagagtggagcccagcactctgcattttaacaaaccttctagatgactctaatacacaccaaagcttaagaaccactgtcttaggaggatcaggtatcttaattccctccctgctcaattgatactaaggtctgaatttatccactgtattctcaagaacctcgaagaatctctacaaagttagtaataaataatcttccttcaggaaagacagtggtatttgcacatggttctttacagttacttggtgagaacaacagaccaagacagtctgttctctgctaatgagattatcttcagggggccttaggaactttgtttttcttgatctgctgaattggtggttactgcttcagcagaggcagcctcacttgatttgttcaggctcccaaggatgctggataatatcactagaatccttccccgtgtgagaatgaggattatctgatgggaaaggcaaagcctctctaaggacatgcatttatcccatgaaaataatatactaccacaaaatacaaataaatgctagagaaacaaccatttaaatggcactgctgggatttccagttaaaggtagtaccttgagccctactatgtccccaaacaacaacaaaaacttagacaattttgtgtttattttttaaaggcataaatccaaaagaacaagaaagaagaggagacaaacgctagaaagcagatgggagttaggcactaacttacagcagacccgcaaagctgaattttggccagaaataggaaaaagtgaaaaacaaccaaacttccatgacagaattcctaaaagacaataaaattagttgattttggtacttctgcaagtcaacagaagggcactgcttaaaagagcaattagacttctctcatcctctcctataccttgcataggagacggaaccttaaaatataagcttccttggctgagagataccaggaatagtttattacagactaccatgctaacaactgaggaataaaatgaaagtttacagctttcttccctctttgggttccagaatgctgctagttagaagactgatggtcaggaatgttgacagtcagctttccaggcaggagagtcttctctggagaatctgaccagtcaagagaaaaacagctataacaatggttctcaaagtatggtccaggaactccaaagattccctcctctcagagcctgagcaaggtcaaatctatttgcaaaataatactacaatgtcatttgcctgttttactctaattctctcaaaagttcacagtggagttttcaaatgctgcaccatgtgtgatactgtaagatattgaaggcagaaacagatgtggatccacctgtcttttattaagctggacattaaaatgatccacaaaaatgtaaagtaatgtcactcttccaatatgttactttaaaaaatagagtcatttttcattaaaaatagattatctatgttagcatgtaacgggtttactcttgttatttttgatgaataaatattttgaaattcaattttaatttctattagtaaatattgacaaatgtaacccacataaacaaaagttctctgtggtcctcagtcattttttaagcatgtaaaatggtcctgcgaccaaagcatttgagaactgatgagctaaagaaactgacattggggttccagcagttaaaaagtctgtccacatacaccatcccacagtgaagactactacccgcaatcccaactacgcacatggagcttccaatctgcttttaaaaattactttaaaacacagatacagaaaaccacataaaacaaatatataccttagcaatttattataaggctaacaatcttgaaattatcatcctcaagaaataaaactttgccagacacctcagaagtccctctacatgcctcatagacatagagtttagtcgtgcccctgtcatgtttttttttaaattgggtaagatatacaatgtaaaatttaccatcttaatcactttgaatgtacagtttggtttacccgttttaaaatttaataagtttctatagtttcttttagtctaaaaattccttcccatcactttctttttcttacaatttatctattgataaaagcagactgggccagtagagtgttctgcaccctgaattttgctgattactcatggtgcaattccgtatgttcctctgtcctcaatgtttcttttcttttctttttccccataggttactggggtacaggtggtgtttggttacatgagtaagttctttagtggtgatttgtgagattttggtgcagccatcacccgagcagtacacactgcaccctatttgtaatcgtttattcctcacccctctcccatccttctccccaagtcccctaagtccactgtgtcattcttatgcccttgcgtcctcatagcttagctcccacatatcagtgagaacatatgatgtttggttttctattcctgagttacttcatttagtataacagtctcatccaggttgctgtgaatgctattaattcattcctttttatggctgagcagtattccaccgtacatatatatcacagtttcttcatccactcattgattgatagacatttgggttggttccacgattttgcaattgtgaattatgctgctataaatgtgtgtgcaagtatctttttcatataatgacttcttttcctctgggtagatactcagtagtgggattgccagatcaaatggtaatcctacttttagttctttaaggaatctccacactgtttttcatagtggttgtactagtttacattcccaccagcagtgtagaagtgctccctgatcaccgcagccatgccaacacctactgttttttgattttttcattatggccattcttgcaggagtaaggtggtatcacactgtggttttgatttgcatttccctgatcattagtgatgttgagcattttttcgtatgtttgttggccatttgtatatcttcttttgaaaactgtctattcatgtccttagcccactttttgatgggactgtttgtttttatcttaatgagttcactgtagattctggatattagtcctttgtcagatgtatacattgtgaagattttctcccactctgtgggttgtctgtttagtctgctgactgttctttttgccatgcaaaaactctttagtttaagtcccagctatttatctttgtttttattgcatttgcttttgggttcttggtcatgaaatccttacctaagccaatgtctagaagggtttttccaatgttatcttctagaatttttatggtttcaggtcttagatttaagtccttaatccatcttgagttgatttttgtataaggtgagaaatgaggatccagtttcactctcctacatgtggctagccaattatcccagcaccatttgttgaaaagggtatcccttccccactttgtttttgtgtgctttgtcgaagatcagttggctgttaagtatttgggtttatttctgggttctctattctgttccattggtctatgtgcctgtttttataccagtaccatgctgttttggtgactatggccttatggtatagtttgaaatcaggtagtgcgatacctccagatttgttcttttcatttagccttgctttggctatgtgggcaattttttggtttcataagaattttagaattgttttttctaattctgtgaagaatgatggtggtattttgatggagattgcattaaatctgtagactgcttttggcagtatggtcattttcacaatattgattctacccttccatgagcatgggatgtatttccatttgttcgtgtcatctgtgatttctttcagcagtgttttgtagttttccttgtagaggtctttagcctccttggttaggtatactccagagtatttaaatttttttgcagctattgtagaaggggttgagttcttgatttgattctctgcttggttgtttttggtgtgtagaagagctactgatttgtgtatgttaatcttgtatccagaaacttagctgaattcttttatcagttctgggagctttctggaggagtcttcagggttttcgaggtaaacaatcatatcgtcagcaaacagtgacagtttgacttcttctttaccgatttggataccctgtatttctttctcttgtctgattgctctggctaggatttcctatactatgttgaagagaagtgatgagagtgggcatccttgtcttgttccagttctcagagggaatgctttcaacttttccctactcagtattatgttggctgtgggtttgtcacagatggctttcattacattgaggtattgtcccttgtatgctgattttgctgagagttttaatcataaagggatgctggattttgtcgaatgctttttccacatctgggtaatgctggcttcatagaatgaattagggagagttccctctttctgtatgttgtggaatagtgtcaaaaggattggtaccaattcttctttgaatgtctggtagaattctgctgtgaatctgtctggtcctggacttttttttgttaatttttaaattaccattttaatctcgctgcttgttattggtctgttcagggtatctaattcttcctgatttaagctaggagggttgtatttttctaggactttatccatctcttctaggttttctagtttatgtgggtaaaggtgttcatagtagccttgaataatcttttgtatttccgtgttgtcagttgtaatatctcccatttcgtttcttattgaggttatttggattttctctctccttttcttggttaatcttcctaatggtctatcagtttaatttatcttttcaaagaatcagctttttgtttcatttatcttttgcattttgttgttgtttcaattttatttagttctgctctgatcttggttatttcctttcttctgctgggtttgggtttgggtttggtttgttcttctttctccagttccttgaggtgtggccttagaatgtctgttgtgctctgttaggcatttagggctatgaactttcctcttagcaccgcctttgccgtatcccagaggttttgataggttgtgttattactgtcattcagttcaaagaacttttaaatttccatcttgatttcatttttgacccaaaagcaggttaattttcatgtatttgcatggttttgtaggtttcccttttggagttgatttacagttttattccactgtggtctgagagagtgcttgatataatttcaattttcttgaatttattatggctcgttttgtggcctatcatatggtctatcttggagaaaattccatgcactgctgaatggaaagtgtctccgattgttggatgaaatgttctgtatatatctattaagtccatttgttccaaggtatagtttaaatccgttctttgttgactttctttcttgatgacctgtctagtgatgtcagtggagtactgaagtctcccactattattgtgttgctttctatctcatttattaggtctgttagtaattgttttataaaactgggagctccagtgttaggtgcatatatatttaggactgtgatcttttcctgtaggacaaggccttttatcactatataatgtccctctttgtcttttttaactgctgttgctttaaagttcattttgtctaacataagaatagctacccctgctcacttttggtgcctatttgcatgaaatgcctttttcccccgctttactttaagtttgtgcgagtccttatgtgttaagtgagtctcttgaagtcagcagatagttggtttgtgagttcttatccattctgtggttctgtatatctttttttcttcttttttttgagatggagtttcgctctgtcaccaggctggagtgcagtggtgcaatcttggctcacggcaacctccacctcccaggtacaagcgattctcctgcctcagcctcctaagtagctgggattacaggcacccaccaccacgcacagctaatttttatatttttagtacagatggggtttcaccaagttggccacaatggtctcgatctcttgacctcgtgatccacccgcctcggcctcccaaatgctgggattacaggcgtgagccactgcacctggccagttctgtatcttttaagtggatcatttaggctatttatattcaatgttagtactgagatgcaatgtaccattccattcatcatgctatttgttgcctgtgtactgtggttttttgtttttgctttttaaattgtatttttgttttataggtcctgtgagatttatgcttttaaagaggttctgctttgatgtgtttccaggatttgtttcaagatttagagctccttttagcagttcttgtagtggtggcttggtagtagcaaattctctcagcatttgtttgtctgaaaaagactatctttcccacatacatgatgcttagtttcactggatacaaaattcttggctgataattgtttttgtttgaggaggctgaagacagggccccaatcccttctagcttgtagggtttctgctgagaaatctgctgttagtctgataggttttcctttaaaggttacctagtgcttttgtctcgtagctcttaagattctttccttcgtcttaactttagataacctgatgacaatgtgcctaggtgatgatatttttgcgatgaatttcccaggtgttctttgtgcttcttgtatttggatgtctaagtctctagcaaggctggggaagttttcctcaattattcccccaaatatgttttccaaatttttagatttctcttactcctcaggaacaccaaatattcttaggtttggttgtttaacataatcccagacttcttggaggctttatgcatattttcttattcttttttctttgtctttgttggattgggttaatttgtagaccttgacttccaactctgaatttctttcttctacttgttcaattctattgctgagattttccagagcattttgcatttctataagtgtgaccaatatttcctgaagttttgattttttttttatggttatctatttccttgaacatttctcccttcacttcttgtatcattttttggatttccttgcattgggcttcacctttctctggtgcctccctgatcagcttaataactaacctcctgaatgctttctggggtaaatcagaaatttcttcttggtttggatccattgctgctgacctagtgtgattttgggggggtgttaaagagccctgttttgtcatattaccagagttggttttctagttgcttcccatttgggtaggctctgtcagagggaaggtttagggctgaaggctgttgttcagattcttttgtctcacagggtgttcccttgatgtagcactctcccctttttcctatggatgtggcttcctgagagccgagctgcagtgattgttatctcttttctgggtctagccacccagcaagtctaccaggctccaagctggtactgggggttgtctgcacgagtcctgtgatatgaactgtctatgggtctctcagccatggataccagcacctgttccggtagaggtggcaggggggtgaaatggattctgtgaggattcttggctttggtggtttaatgttctatttttgtgctggttggcctcctgccaggaggtggctctttccagagggcatcagctgtggtagtatggagaggaactggcagtgggcagggccctagaactcccaagagtatatgccctttgtcttcagttactagggcgggtagagaaggactagcaggtgggggaagggctaggcatgtctgagctcagactctccttgggcaggtcttgctgcagctgctgtggaggatgtgggtgaggttcccaggtcaatggagttgtgtacctgggaggataatggctgcctctgctgagtcatgtaggttgtcagcgaagtgagggaaaggcagcagtcacaggcctcactcagctcccacacaatccgaaaggccggtcttactcccaccgtgcccccccgcaaaagcaccgcatctatttctgtttccagacagtgggcaagcagggttgtgtcctcagtatttctatttcctacaaattggcagctggatccagaggtaaacagtagatttagaggcttaataaaacctacattcactctgatctgcatttttttttttggttttttggagacagggtctcattccgttgcctttgcagtggcacaatcacaatcacagctcactgcagcctctcaacgtctctggaccaagcaatcctcctacatcagcctcccaagtagctgggaccacagcatgcaccacctgcaaagctaatttttttttttttttatagagacaggatctcgtgtgttgcccaggttggtctcgaactcctgggttcaagtgatcctcctgcctcagcctcccaaagtgcttggattataggagtgagccacaatgtccagcccaatctgcttattaacactccactgttaagcctaagaagatagccaaagattgccaaacattttaagacagcatctaatatgacagggatctaaataatacagaagcttggaaagttagagcacatagagaagaaaacttctattattaatttgtccaagctcaaagaaataacagaagacactgcatccaggaaacaagcacaggatgctatagataaggaatatttagaaaaggaactctcagaaagtaaaaaataagtagctaaaattaaagactcaaatatagtttgaagataaaactggggaaatctcccagaaagtaggaccaaaaagagagaaagagagatttatggaatccaccaacagatgaaaaaagacctaaatcaaagactaccacaataaaatgttataacaatgaaagcaaagaaaatgtcctgagcatttccagaggcaaatacacacacacacaaataaaatacattttatttaaaacttcttaagcacaacactgaaagacttaagacaatgaaacaattctttcaaaattctgaggaaaatgtttccaagctagtattctgtcttagtccatttcctgatattataaagaataccacaaactgggtaatttataaagaaaagagatttatttgcttcatggttctgaaggctgagacatagtaccagcatctgcttggccatttggtgagggccttctttttgcatcatcccatagcagaaagcagaaaggcaagcaaactccaccctcataacctaatcacctcttaaaagtaccacctctaatactatcacaatggcaattaaatttcaacatgagttttggagggggtacttaaaccatagcatattctacactcagtcaatttagtatatgggaaattaaaacatctgcaaatactgaaggtctcaaatattttgtctcccaaacacattttttcagaaagttacttgaagatgtactccaccaaatgaagtcataaaccatgaaaaggaagacatgagatccatggaagagaggatccaacgtattagataggcaaagaaaatccacaagatgataccgcccctaaacaacagctatgcagcagaaaacaatcagtcaagattggaacagatcagaagactccaggaaatatttattcaagataagaaaatgataaattactcaatgtttctgaatgatatgaacaggatatttatacaactgagaatggttcggaattaatgaattagtgttgagaacacagataactaattaaatgaacaagaaatagaattatcaattccaggaaaaacaaaatactgtgcaggcaaggaaaagtaactatcaaatcctacatagtttagctgtgaattatatttatgtaattgtcataatgtagttaatgattatgatataactatattggaggatggcaggatgggaagtatgcttgcatacagcaatgtagggtgctagtcaaagagaggtaaatcctcctcttccttactgagaagtcaatacatgaggcctaattctgaaaaatcaagaaatatgataaattataaataagggggctaataccaaatgaatcagagattaaagtgattctctttgagaaataggaaatgactctccaaataatgttaatatataactgataaatagaaaagctaaatttaaacaaacactgttaggttggtgcaaaagtaattgtggtttttgtgattaaaagtaacagtattgctggagctatggatagtagacactctttcaaagacagctgaacatattttatgctactatagttttctctttcattgctttcaggttgtagcttaggtcacatttctcactcacaagagtgagtgagtggaaaattgtaaagcaaagcaggattactatggaaggtagcactccaaagtatcctgtaggaatatatccccatccctagccccaacctgccccaactatggatcaaagattaaaggctgggaaaaccagccttagaactgacatcaagtgcatatgtcaagagaccggtcaggacagaccatggactatgggcctagagcataaaagctgccagctatgcagcagcaatggccacaagggattaatctgagctcagtacaacttgaccacagagaaaggtgagattaaaatgagtcagaccctagtaccatgggaaaatttcatggttgcttggcagctccttaataacctatgggcacaaatatttacttctaactgaccccttaagtaaggggattaaagtgtctgatgtatataaaatacaatcggcacagcagcactgcttttagaacaagtattcactctctgagatatgttcagcaatatagatcagagttaacattttgtgaacaaaccagaaatcatactgctcagaacccatatgtttcagatcaaaatgaataaatttgaaaataggacttgaaaaataaggctcagaatgtatatcagcaaagtggaaaagactggaatacgaaacataatgcttccagcactgggaggaccccagatacagggaggaccccagatacaatacaccagcattccttatcaagagtaagggaaataggctgggtgcagtggctcacacctgtaatcctagcactttgggaggccaaggcaggagcctagaaattcaagaccagcctgggcaacatggcagaaccctgtctccacaaaaaaaaacacaaaaattagttacgcacggtggcgtgtgcctatagtcccagctatgtaggaggctgaggggagaagattgcttgagcccaggaggcagaggttgtagtgaactgagactgcaccactgcactccagcctgggcgacacagccagaccctgtctcaaaaaaaaaaaaaaaaaaaaaaaaaaaaaacagaatggaaataatatttactaagtacttactatatgccaggtttacaccagtaccttaacgctatttcatttaatccttacaataagtgtaggaagggttattctcttttccaggtgaggaaacaggcttagagaaaggatataatttgccaaaagcacgattagttacagaactggaacttgaaaccagaactatctggctccaaaggccttatctttccattaacctccctgcaaaatacgtgaaaccctatactgagatgtttcacatctatgaaagggcactaagaattagtaacataatcaccttatagtagatgagtagtataagacatcactcaaaattccagtaaagatatacatgaacaagattcctatcttccccctggcaaaagcagtaggtattaatttcaaatatgcccacagatacttaaataatatgtgcgtcagctaaagtgatttaaagatgaggcatagatttccatcactctcaggaagaagaaattgtctcttcagaatatattctgaacactacatcgccaccattcacttgaagcctttatcactcaaaagctttcagaggaggaaaccaatattaaacattcttatttaggctaaattaaaaatgatttacttactcttgaagaggcttctaattaaaagagtaaaaaatcgctttgacaaacatcacactagatgacatatgactagtcactacaagactaaacattgtaccccttagtgtaggtagggggaaattttgttctccaatgctgtgtgccccaggttgtttcctcaaccaaaattcagaaaccttctcccatcactgctatcctccctttgtttttaccaacttaactgaggtgtaactcattcatttaaagtgtatctgaattgtgaaaacatatacacccacgaaactgctaccagaatcaagatacaaactacttccaccacctataaaagttttctcatgcaccttgtagtccacccctgccttcactcccaggcccagacaactgttgttctgctttctgctatggtagattagtttgcatcttctagaattttatatgactggaatcacgcaatatgaattctgatatggtttagctgtgttcccacccaaatgttatcttgaactgtagttcccataatccccacatgtcgtggaagggacccagtgggaggtaattgaatcatgggggtagttacctccatgctgttctcgtgatagtgagttctcacgagatctgatggttttataaggggttttccctgcctacactcagcacttcttgctgccaccatgtgaagaaggacatgcttgccatgcttcccctctgtaagtttcctgaggcctccccagccctgcggaactatgagtaattaaacctctttcctttataaattacccacgaggtcaatagttcaagaccagcctggccaacatggtgaaaccccgtctctattaaaaatacaaaaactagccagcgtggtggtgagcacctgtaatcccagctactcgggaggctgagacaggagaattgcttgaacccaagaggcggaggttgcagtgagccaagatcacaccactgtactccagcctgggtgacagaacaagactccatctcaggaaaaaaaaaaaaattacccactgtcaggtatgtccttatagtagcatgagaacagacgaatacatactcttttttgaatctggcttctttcactcagcataattattttgcaatttatctatgtgtataatagttgttttgtattcctaagtaatattttattgtatggatagattatattttgtttatccattctcttattaatgaatatgtggattgcttacaattttggctattacgaataaaactgctatgaacaataatatacaaatctttgtgtgaacacgtatttttatttatattgggaaaatatgtaggagtagaatggctgaattttatgttaagtttatgttcaactttttaagagaatgccagttttgcagtttgtaacattttacattcccaccggcaacaaagttctagttgctccatatccccaattggtattgtcagcctttttcctttcagccattctaatggatatctggtggtatctcattgtggttttactttgcatttccctggtgactaaagctactgagcatcttttcacatatctacaattactcagatatcttttgtgaaaggtctattcaaatcatttggccatgttttattttgttgtcttattattcgttttaggagtctgttatatattctggtcaaaagtcctttttcatgtatatatgtatatatatagtttcacctagtctgtgactttctttttcatttccttttcttaatgatatcttccaaagagcaaaatttcttgatttttataaaacccaatttaccattttttttctgtatggtttatgtttttggtgtcttatctaaggaatcactgcctaccccaaagtcacttttgtcctacattttcttccagaagttctatagttttagtttttagatttatgtcgtatccattaaaattaatttttttgtatggtgtgaagtagggattaaggttcatttttttcacatggctatccagttgttccaaccccatttgctcaaagtctttccttttcttcactgaaattgccttggcacctttgtcaaaaatcaattgaccatacttgtgtggctccacttctgggttctctctttagttccactgatctatatatctatcctttcaccaataccacactgtcttgattactgtcacatcatagttcatcttaaaatcaggtagtataatttctccaattttgttcaccttttataaaactgctttggctaatctcggtggtttacattaccacaaatttttaaatcagcttatcaatttctttttttttttttttttttttggagatagagtctcactctgttgcccaggctggaatgcagtggcatgacctcggctcactgcaatctccacctccagggttcaagcaattctcctgcctcagcctcctgagtagctggaattacaggcatgtgccaccatgcccggctaatttttgtacttttagagagatggggtttcaccttgttggtcaggctggtctcaaactcctgacctcgtaatccacctgcctcggcctcccaaagttctgggattacaggcgtgagccaccacgcccagcctcaatttctattaaaaaaaaaaaaaaaccttctgaaatttgtatttgaatagtactgaatttatacacagatcaagttagagaaaactaacatgttaacgatattgaatcttccaacccaagaacatggtaaatttgtctatttagatctttaatttctctccatcaatattacctaattttcaacatacaggttttatacttctgttaaatgtattcctaagtgttatggtttttaatgctactgtaaatggaatttagtcccattttcctattgtttgctgccattcaagaagcagaactctctgtctttggtacaatttatctggtaaaagagggtaatttctacatggaattattatttcataaacacattatagccacattatctcaaagttaaccacttttgtttttgtttttaacgcagtaaacatttctccagtgtctactattatttgaaagtaccaaaacaagggaggagaaacatggaaccatataacaaatactacataagctcacaatctagtggaaaaatgagtaaatcattttaatatatgcagtatatgctataactagagaatgtataaaatattcaggaagtcttaaaggatccagagaagttcaccagaggcattcagatagaagaaatacatttttctactattgtatactatcagttgtactgaaaagatatacagatcaattaacaatattgagtcttccaacccaagaacacagtaaatgctgtatagatgctatttactatttcctttttaaaaacacctttattagaataagtactacatgaaactactcttgaatatagtgtaagtgatcatattaatatttactttcttaaatccatgtactttcttaaaaacaagattgccacaagaaagaaataagtttgctgagatttaaaagtctttatgttagaagagagagtacctcttaccaaaatgagcatgtttcctgttgctagattatgctggtaggtatgcggtggcatctatttcaacttagataataacacaactctataagcacaagctgtttccggtcgaaattattagtcatgaacaccaaaatctgaatgagctctatccaatctcaaactgcttgctgagcaattccacaagagaatttgatggggacagccaactttagagcctagaaagtgatcacgtattacaagacggtggttatgggtactaggtaacagcataaaagcagcactgaccaactgaaaggcaagagatgatactgacgctttctttgtcctattgaaattttttttctatgactggcactaactctgagacataaatcatatgaataccttgctcagttgcagattcagatttaaacaaggagctaagtgccaagttttcatccctatgccaagtgtttgaaaagtaagttagaaactgtaaatcttatgtcttttctacatatatatatctaaatttattctgtcttgtatgtaaagagttgtctcaatatctatagaatattatattatgaacaaaaaagaatttctagacagtttagagatgctttatccaaaagaatctaaaacattcacggacaggtttctggctgtctactgtgaaacccctaaaaatgtaaaattcaatatgtgtacttttctaggtggaaagtccacagtttccagtttctccatgagatccatgaactaaaatagctttaaaaacactatatttaaaagaaaagaaaagaaaaagagaccgggtgtggtggctcatgcctgtaatcccagcactttgggaggccaaggcaggtgggtcacctgaggtcaggagttcgcgaccagccaggccaacatggtgaaaccccgtctctactaaaaatacaaaaattagctggccatggcgaaaggcgcctgtaatcccagctactcatgaagctgaggcaggagaattgcttgaacccgggaggcggaggttacagtgagccaagatcgtgccattgcactccagcctgggcaacagagtgaaactctgtcatagaaagaaaggaagggagaggggaggggaggggagaacaagaggagagcacaggagaggagaggagaggagaggagaggagaggagaggagaggagaggagaggaaaggaaaggagaggaggaaggcaagcaggccaaaaaaaaaaccattatattaaagagttaaacgtttttaaaaagaaaaaagatgtaaacaattaaaaattaggtaatctctgaaagagtacagcaatgaaagaaaacacaaaggaaaaccattttactatgtatttcaaataaaatcctaaaattaaaaggtaagtcaaaaactaaggatttttttttctactctctccccttcttgaaagcgaaatattttatggaaaatacacaaccatatattacattcacagcaaagtgtttttataactcaagacaggtggagatgttataaagtaggcattctgatttactgctgatatacttttccaagtctggaccacgtcaatggatatcaggatggaaggggttagaagaactcaaggttgcttggaaattaggcttaataagatatgattaatgagtaaatgtacgggatggaagagaagaaagacttgaggataatactcaggtctctggcttgatccactaaataattgagagtgaatattaagattaagaacacagaagaattgctggttggtagagaaagatgatgagttccattttgtacatgttggatttgaggaatctgtaggatattcaagaaaaatacagttaaatatatgaatccaaactataaaaaaagctaaagtgaagatatacttggatattataagcatttttataaaaagtatctagattgctaatggaaacgtgttgaataagaagacagcccaggacagaactttgagaaatcaacagctaagagaccagcagagtaaaggagcacataaaggaaatcaataaagaaaatcagaaagaggaagaaaatcaggagtgagatgtcatagaacccaaggggcaaaaacagttttggaattcttaaagacagagaagagaagggggactaacctgtattaaatgtctactagatacaaagtatttcaaacacttatactttaacaagtatactcctcattttgagcattaggaacctatcattcagatagtttaaataattgtccaaataaaactgtaagtgctaaaacagaattttaattccagtatttcaaaatccatgttcattccactgaaactaacggaaaggactgaggaagcactcagaaagatttggatggtcaagccctgacttaaattgtggttgatttcagcacaactgactgccaaaagccagttttatcctgatgttatcatagcacctcagctaggaaaaattaaaatgctaataatttttaaaatccagatacttcataaattagtcagatgttcttcaaaaaggtgggtaactgttgaaagcagagttacttactcattcagagaagataacagaacacagatgtcttatgccacaatggattgacaattagagcacctgagttcccaagaacattagcaaattcagaaactcctgtataaatctttttttttttttttttgagatggagtctcactcttgtcacccagcctagagtcctatggtgtgatctcagctcactgcaaccttcgcctactgggttcaagcagttctcctacctcagcctcccaaatagctgggattacaggtgcccaccgccatgcccagctatttttgtatttttaggagagacagggtttcaccatgttggccaggctggtctcgaactccttacctctggtgatctgcccacctcagcctcccaaagtggtgggaggcatgagccaccgcgcccaacctcctgtataaactattaatagctactgtaccatcagccacagaataggttgctgagggatgctccaagaccaaagaaacaaaaagcgcctatgggagtataattactgtgtctccatgcacaataaagattagctggttgttcaaaaacctttttttttaatgtcatgcccaagaacagttggggaacatccaaatccaatcacaatgaatggcagtattcccaggatggaataactaaaatgcaactgacaggaaatatagatcatcagtagtatagtaacccatcaagctaaatgcataaatggcatccagcacgtgggaaattttgctctgaccagcatgatcaagcaagcaggtatatttctgtggaaatggcatctgagccatcacagaacaatactctgacaatatcattcaactacactccccttgcttgtgttgcatgattagacaactgtctggttaaaatttaggctgttgtagaaaaccaaggtctgagtatgcatatgttctctcaaactctcttccctttaacctcagctttcttgaggccactaagttttgtcaaaatcaattgattttcttatgtcataatgccagacacagagcaaggcaaggaaaataaaaaataaagacgaccttcaatcgaaacacacaatccaatggaaacaagtaaagcctaaaaaggtatttttctccccacaagccaatgcaccttctctctttggtaagcagtggtaaaaatgtcatagaatagtatgcaatactcttcatatcaaagaaacccagccactataacaaccacacagaagtcactatcaagagaatgagtatcagctgtaattccccaaactgaagtataaacattaatataagaaataactctaatggaggagaggacaaggaaaacttcttggatgatatggtatttgagagtagccttgaaaactaagatttcaataagcaagaaaagctctgtcaggaaagaagggtctccaaggttgaagaaacattgatttagtaagtcaacaaatatttattgtgcaagtatgtgtagatcactgtgttcagcactttgagttaccatgaaccagactctaaggcttatatttcattggtcagctttcagtcacatagccacacttagctttaaggcagtttgggacatgttttttgtttttgttttggtatccatgtatcaaactaaaactttgcagatgacatgactgtatatttagaaaccccatcatctcagcccccaatctccttaagctgacttcagcaacttcagcaaagtctcaggatacaaaatcaatgtgcaaaaatcataagcattcctatacaccaataatagacaaacagccaaatcatgagtgaactcccattcacaattactacaaagagaataaaatacctaggaatacaacttacaatgaacgtgaaggacctcttcaaggagaactacaaaccactgctcaacaaaataaaagaggacacaaacaaatgtaaaaacattccattctcatgaagaatcaatatcgtgaaaatggccatactgcccaaggtaatttatagatttaatgctatccccatcaagctaccactgacttacttcacagaattagaaaaaactactttaaacttcatatggaaccaaaaaagagcccacatagccaagacaatcctaagcaaaaagaacaaagctggaggcatcatactacctgacttcaaactatactacaaggctacagtaaccaaaacagcatggtactggtaccaaaacagatatatagaccaatggaacagaacagaggcctcagaaataacaccacacatctacaaccatctgatctttgacaaacctgacaaaaacaagcaacgaggaaaggattccctatttaataaattgtgctgggaaaactggctagccatatgtagaaagctgaaactggatcctttccttacaccgtatacaaaaattaactcaagatggattaaagacttgaatataaaacctaacaccataaaaaccctagaagaaaacctaggcaataccattcaggacatagacatgggcaaagaattcatgactggaacaccaaaagcaatggcaacaaaagccaaaatagacaaatgggatctaattaaagagcttctgcacagcaaaagaaactatcatcagagtgaacaggcaacctacagaatgggagaaaatatctgcaatctacccatctgacaaagggctaatatccagaatctacaaagaacttaaacaaatttagaagaaaaaaacaaccatatcagaaagtgggcaaaggatattaacagacacttctcaaaagaagacatttatgcagccaacaaacatacgaaaaaaatgttcatcatcactggtcatcagagaaatgcaaatcaaaaccacaatgaaataccatctcatgccagttagaatggcgatcattaaaaagtcaggaaacgtggctcacgactgtaatcctagcactttgggaggccgaggagggcggaccacgaggtcaggagatcaagaccatcctggctaacaggtgaaaccccatctctactaaaaatacaaaaaaaaaaaaaaaaaaaaaaaggccaggcgtggtggcagatgcctgtagtcccagctactcgggaggctgaggcaggagaatggtgtgaacccgggaggtggagcttgcagtgagccgagatcgcaccactgcctttcagcctggacgacagagcgagactccgtctcaaagaaaaaaaaaaagaaaaaagccaggaaacagatgctggagaggatgtggaaaaataagaactcttttacactgttggtgggtgtgtaaattccttcaaccattgtggaagacaatgtggcgactcaaggatctagaaccagaaattccatttgacccagcaatcccattacattatacccaaaggattataaatcatgctactacagggccgggcacagtggctcacgcctgtaatcccagcactttgggaggccgaggcgggcggatcacaaggtcaggagatcaagaccatcctggctaacacgatgaaacccagtgcctactaaaaatacaaaaaactagccgggtgtggtggcaggtacctgtagtcccagctactcaggaggctgaggcaggagaatggcaacccgggaggccgagcttgcagcgagtccagattgcgccactgcactccagcctgggcaatggagcaaaactccatctaaaaaaaaaaaaaaatcacgctactataaagacacatgcacacatatgtttattgcggcactgttcacagtagcaaagacttggacccaacccaaatgtccatcaatgatagagtagattaagaaaatgtggcacatatacaccatgtaatactatgcagccataaaaaaggatgagttcatgtcctttgcagggacattgatgaagctggaaaccatcattctaagcaaactattacaaggacagcaaaccaaacaccgcatgttctcactcataggtgggagttgaacaatgagaatacatggacacagggcggggaacattacacatcggggcctgtcagggggttgggggctggggaaaggatagcattaggagaaatacctaatgtaaatgacgagttgatgcgtccagcaaaccaacatggcacatgtatacctatgtaacaaatctgcacattgtgcacatgtaccctagaacttaaagtataattttaaaaaaacagggagttctattattatgaaggaaaggaataatggaccttggaaaacaaccagcagtctctgctacctaggaaacaggtcattgaaaacagaaataagccaaaagaaatttctaggatggtggtgaaggaaagtcccactttaaaaattgtgcagcacactaaaagccattcagtctgtactggagcaggtggatggggagtaggcaagagggggtactaaaaagtgtatctcaaacaaacaaaaactgatagaccatggtattgagagaaattctagagtgctgttgagtttgaagacagaataataatagacacatttcaaactacacaaatataaaacaaagcaattattaatgccaggaaatctccaaaaatgagtatgggaggaaacatgattataggatactccatgcctcaactgttgtggtagctcatctccaaagacggccctcaacactacctgatctttatactctcttctaaccacctcactctctcactttccataatgacaaattcaaacctcctctactctcctcaaacactagtgcctttcctttgccacaccaaaagccagccaagtaatttcttagagaaaataaaagtcatcatttgaggttggtaatcgtgaatttagcataaaaccaaactgcccttttttatgactttctaacatagcccttatattttctacaggaacaaaatcaaaagtttatcatgtaaattatggttttaccaaacaagtgtaataaaaatgcaagggagaaaaggtttgtagggcattgccaaagtgtgttactgactaacatgctatcatcagtagagtggatcatgatgtttcactgaacgtccaggcaatcaaggtccctttggactatactgtgacagagggcagaagagttgatacagccctagggcacaaccataaatgtatacttttgtcaattccaagtgaatgtgaactccttctgattctctttcctgtcaggcaggaactgaaagaatgcactctccatgtcaatagttgcttatgaagtaccacaggctgtgttcatctcatctagtcaagataccgtttctggtatagcagctgtggccaggaaattgcttgattgaatgtactgtaatagtttaccatcacctagcacattccatcagtcctttgcaaggacagtctcattaattaagtaggaatatgataggaatcaccacacttcagccattaagtcactgagactgacattaatctctgccattctaccaggatatagtattatttccgatttactatcttgcagagaaagagaagggtcagtggtttctatttgtcttttcctaccatgataattctctctccataagtcaaagaaccagtgtgatggttctgcctgttattaaatatgtccatgctgattatgcattcaggaagtgggaaaatgaccacagagtatgtctagggacacagtggaccgaagtgtaaaacagatttgggccagcactccattcattaccccatctccacatgctcccattaacatcagagccactgtggtgttttgggtacccaagcaacaatgttagcttgactgtattcccaagaatctttgaaacacctggttagattcctttctccagtgtactgttacttggacaagtgagcatagattcctttgagaaaggttggacagctgctctgtgtacatttgctgtattattgcagggttcttcatgaaggagacccttcaattgattaggtctggatcagagaactggtccaagtctgggaactgagcaaaagatcataatttttcattacggtaaacagaatgatccccctagagatgcctattctctaatccttggatcctgtgaattttacgtgacatggctcatgggattttgcaaatataactaaggttatacacttcaaaatatagattatcctggataatctggctagacccagtataatcacatgaacccttaaaagcaaagaaattttttctagctggtcagaaaacagcagcagaaggatagagttcaacagattcaaagcatgagtgggactcaacctgccactgctagtggactgagcctccatgttgcccatggaaacatgagaaggaatgcaggcagcctctagaagcaaagactggctgccggctaacagcaacaacaacaaaaacggacctctcatatttaagagatcccgctgatctacatactcttcaactttgcaactgaaattgtagtccacagaccagtggaatcagcatcacttggaaatctgttagaaatacagcatctcaggccccactccaaatctactaaatcaaatgatgcatttaaaaaaagattcataggtaattcctgctgatgttggagaaggcctgccctatatcaattgatattatcagacttattaatttttgccactcaaatgtcaacgaaatttcatgtggtcttgatttgcatatctctagtgtgaacacaggttcaacacatgctggctatgtgtttcctcttctatgaaacgcctgttttttatcttttgcccattttcctaacgggttatccttattgatttattgttgcattatatattcttgatactgactctttattagttatctatattgcataaactttttatcagtttgtaatcagtctttgctatctttaagggatttttttgataaataaaaggacttaattttaatatagtcaatttgaccaaacttttcttttttatgtttaagaattcccgccacaccccagaatcagaaaaatattcacttccatatgttctaccaagcattttattttgatatttaagtacttttttccatctggaatttacctttgtgtatcatgtgaagaaccaatttcaatttcttccctacctgatttttgttttatgtcctcatcaatccacaaaagaacattttttttgaatagactatttttttcaaattattattatttcaattttttaaggaacaggtggtatttggttacatggataagttatttaggtgtgatttctgagattttgatgtatccatcacctgagcagtgtacactgcacccagtgtgtagtcttttgtccctcacccccctcccacccttccctgcaaggccccagagtccattatgtcattcctaatgcctttgctcccactcataagtgagaacatatgatgtttggttttccattcctgagttacttcacttagactaacaatctccagctttatccaggttgctgcgaatgctgttatttcattcctttttatggctgagtagtagtccatgatatatatatatatataccacattttcttcatctactcgttggttgatgggcatttaggctggttccagatttttgcaattgtgaattgtgctgctataaacatgcgtgtgcatgtgtctttttcataaaatgacttcttttcctctgggtagatacccaggagcgggattgctggatcaaatggtagcttttggttctttaaagaatctccatactgttttccatagtggttgtactagtttacattcccaccagcagtgtaaaactgtttccttttcaccatatctatgccaacatctattatttttttattttttaattatggccattcttgtaggaataaggtggtatcacattgtggtttcgatttgcatttccctgataattagtgatgttgagcattttttcatatgtttcttggccacttgtatatcttattttttatcttttttgagacagggtctcactttgtcacccaggctggagtgcagtggtgcaaccctggctcactgcaacctctgcttcccaggttcaagcaatcctcccaacctcagcctcccgagtagctgggatcacaggcacacaccaccatgcccagctcattttttttttttttttttttttgtatttttagtagagacagggtttcaccatgttggccctggtctcgaactcctgacctcaagcgatccaccagccttggcctcccaaagtgctgggattagaggcatgggccactgcacctggcccatttgtgtatcttcttgtgataattgtctactcatgtcctcagcccactttatgataggattatttgtttttttcttgctgatttgagttcctgtagattctaaatattagccctttgtcagatggatagtttctgaatattttctcccactctgtgagttgtttacgctgctgattatttcttttgctgtgcagaagctttttagtttaattaaatcccatctatttatctttgtttttgttgcatttgcattttggtccttggccatgaactctttaggccaaggtctacatgagtttttccagtgttatcttctagaacttttatggttttgggtcttagatttaagtctttgattcatcttgaattgatttttgtataaggtgagagatgagaacccagtttcattcttccacatgtggcttgccaattatctcagcaccatttgttgaatagggtgtgctttcccccactttatgttttcatttgctttgtcaaagatcagttggctattaagtatctggctttatttctggcttctctattctgttccattggtctatatttataccagtatcatgctatttgataagtatagcctgtagtatagtttgaagtcgggtaatgtgatgcctccagatttgttctttttgcttagtcttgttttgactatgcaggctctttttcggttccacatgaattttaggattgctttttctagttctgtaaagaatggtgatgatattatggcaggaattgcattgaacttatagattgcttttggcaatatggtcattttcacaatattgattctacacagccatgagcatgggatgtgtttccattcgtttgtgtcatctatgatttctttcagcagtgttttgtagttttccttgtagagatcttatacttccttggttaggtatattcctaaatattttattttctttgcagctgttgtaaaaggggttaagttcttgatttgattctcagcttggttgctgttggtgtatagcagtgatatttatttgtatatactgattttgtatcctgaaactttactgagttcattatcagatctagaagctttccaaatgagtctttagggttttctaggtatacgatcatatcatcagcaaacggtgacagtttgacttcctctttaccaatgtggatgccctttctttctcttgtctgattgctctggctaggactcctagtactgtgttgaatagaagtagtgaaagtgggcatccttgtcttgtttcagttcttaaaggaaatactttaaacgcttccccattcagtataatgttggttgtgagcttgtcatagatggcttttattaccttaaggtatgttccttctgtaccgattttgctgagggttttactcataaaaagctgctggattttgtcaaatgctttttctgcatctattgggatgatcattatctttgtttttacttctgtttatgtggtgtattgcatctattggcttgtgtatgttacaccaaccttgcgtccccatcatgaaatacacttgatcatggtgcattatccttaatatattgttgaattcagttagctagtattttgttgtggagttttgcatctatgtttattggggatattgatatgtagtttttttgttgtttttgttatgttccttcctagttttggtatatgggtaatactggcttcatagaatgatttagggaggattctctctttatcttttggaatagtttcagtaggattggtaccaattcttttcttgttgcctgtgatggaatccaatggtgtgatctcagctcactgcaacctccacctcctggattcaagcaattctcctgcctcagcctcccaagtagctgggattacaggcacctgccaccacatccagctaatttttgtatgtttcgtagagatggggtttcaccatgttggtcaggttggtctcaaactcctgacctcaggtgatccacctgccttggcctcccaaagtgctgggattacaggcgtgagccaccacacccagccccaattcttctttgaatgttgatagaattcagtcatgaatccatctggtcctagcctttcattgttggcgattttttaattactcttaatctcgctacttgttatcggtctgttcagaatttgtttcttcctggtttaatctacgagggttgtatatttccaggaatgtatctatctcctctaggttttctagtttgtgtgcataaaggtgttcatagtagtcttgaatgatctttatccattctgccattctgtatcttttaagtggaccatttacaccatttatagtcaactttagtattgagatgtaaggtactattctattcatcatgctagttgttgcctgaataccttgggctttttttcattgtgttattgttttatagatcctgtgagatttatgctttaaggaggttctattttggtgtatttcaagattttctttcaagatttaggactcctttcagcatttcttgtaatgctggcttggtagtggcgaattcgctcagcatttctttgtctgaaaaagactttatctctctttcatttatgaagcttagtttcactagatacaaaattcttggctgaagagaggctaaagagaggaccccaatcacttctgccttgcagggtttctgctgagaaaactgctggaaatccgataggttttcctttatagattacctgatgcttttgcttcacagctcttgagattctttacttcatcttgacttttgataacctgatgaccatgtgcctaggtgatgatgttttgtgaagaattttccaggtgttctttgaggttcttgtatttagatgtctagatctctggcaagaccagggaagttttccttgattgttccctcaaataagttttccaaacttttagatttctcttattcctcaggaacaccaattattcttagatttggtcatttaacataattcccaaatttcttggaggctttgttcattttttttattctcttttgtctttgttggattgggttaattcaaaagcctggtctttgggctcttatgttttcttctatttgtgcaattctattgctgaaactttccactgtatttagcatttcactaagtgtctgtttcatttccagattatgattgtcttttctttatgatatctatttctctggagactgtttcttccatatcctttatttttttttaatttctttaagtcggttttcaccttcctctggtatctccttgagtagcttaaataatcaaccttttgaattctttttctggcaattcagagatttattcttggtttggatccattgctggagagctagtgtgatctcctggggatgctattaaagaatcttgttttgtcatattaccagagttacttttctgatttcttctcatttgggtagattgtttcagtggaaagatctgggactcaatggctgctgttcaggttctgtcccatggggtgatcccttgatgtggttctctcccccttcctctaggaatggggcttcctgagagccagactgcagtgattgttactgcccttctgggtctagccacccttcagggctaccagactccaggctggcaatggggaatgtctgcaaagagtactgtgatgtgatccaccttcaggtctcccagccatggataccagcacctgctccattggaggtggcaggggagtaaagtggactctgtgggagtccttggttgtaatttagtgcactggttttcttgaatgctggttatgttagcagtgaagttgtcacaaggatagactcaggacctctagttagctagggtgtgcaggtggtagaattacctgttgtattctccttctctggggcagagttgttctgagttgctgtagtggcttgagttcattggcctctagcgaggaagtgatgctttcaagagcttgccagctgcagtagtagaagggagatataattttgccctactttggccaggatgagtactcaggtttcttgggtaatgggcagggccacagagctccctagaaattacatcttttgattttggctaccaagatggggagagaaaaaccatcaggtgggggcagggttaggcaggtctgagctcagattctccctgggcgggacttgctgtggccactatgtagtggggaaagggtggctcccaggccaattaagttatgttcccagggggattatggctgcctctgctgcatcatacaggttgccagggaagtgggggaaagctgacagtgacagacctcacccaactcccccacagtcagcaagaccagtctcactcccaccatgcctccctaaccgcactggagttatatccagtcagccagcaagctgggctgagatcttgccacaagctacaagccttcctgctgagaaagcaagcagggctctcaggccttgcctccccacctgccaacatgttcagctgcatcttctgcgctcatatatgcacttcccatttgcccctcaccccagatgctactcagggaagttcacgcttagtcaaaattatcacaaaattcagctaggaggttccttcactctgtagccccttcccaattctgctggctgccttcccttccccaaggacctctgtgaggtaacgccaggaatagcttccatgggctcgagctaaggactgggagtacctacggggctcctcctgctgcttcttctacttttatatttcacttggctccctaaatccattttgtcatgcacgtccatgtgaagagtccaccaaacaggctttgtgtgagcaacaaggctgtttatttcacctgcgtgcaggtgggctgagtctgaaaaaggagtcagcaaagggtggtgggattatcattagttcttatagatttgggataggaggtggagttaggagcaattttttgtaggcagggggtggatcttgtagtacattctcaagggtgggaagaatattacaaattaccttcttaagggcagggaaggatattacaaagtacctttttaagggcgggggaagatattacaaagcatcttctcaaaggtgtggagggtgtatcatacgaagtacattcacaagggtgggggaatatcgcaaagtatattatcgcaagggcggggagggtgtattgtcacaaagtcaatttatcagttagggtggggcaggaacaaatcacaatggtggaatgtcatcagttaaggcaggaactggctattttcacttcttttgtggatcttcacttgcttcaggccatctagatgtatacatgcaggtcacaggggatatgatggcttagcttgggctcagaggcctgacacatttccccagtgggtatgtgtgttcggaagccaacttttcccccctcacactttgggaactcacagttttttgctgtctcacagcatttgcagtgacaagccacttcttacaaagggtctgtgaattctttcagttttcctgatatgttcctgtggtggttcttggagtaaaagttcacagtgtgagtctccagaccctgttctgtccatctaagcgggagctgcacattagtcctgtctcctatctgccatcttttccagcatctcccccacaaaaacaattcttattgaagttaccaatgattttcttgttagcaatccatcttatatgcctagcagtattgatatcaagaactccttccttcaagaaaagtttatttcatcagcttctagcactcagctttctcctgattttctacttactgctccaactagtccttcttagactcctttgcaggctcatctatctctaacccgtcagtaaatgctgctggtgttcctcaaggttccatcctatgcccacacatagaacagtgcctgacaatagtaaatactgagtatttgcaattatcatctaaacgctcactctaaactctctacctaagcaatcccttccattccttattgctcaaaactttagtaactgtttctacacagatgatatatttcttgcccggatttcccctctgagtttctgacccatacatacttgatgtctcctatcctatctccaaagcacctgaaatcagcatgtttaaaattaaactcatgatctccctgccgaataccaacaaacctgctcttatgcagtgttttttgcgaatggcgccaccactcatccagatttatacatcagaaacacatttcctagattcagttcatcacaaagtattgttgatttcctaaatctcatttgaccacttgtctccatttctattctcactatcctagactcaattttccattacctctcacatgaggtaatgggtactacaaacatgggtattgctgcactgtttgagcccctttcaaccttttctccatactatagccagaatcatctttcctaatacatcatgtatcctcctacttgaaatctttcaatacttcttaggataaagttcaaaacccttaacatggcctccaaagatctgcatcatctagacctacagcctcatctcatacccatgttctcctcctctgcattccatggctgttcaattcctgactcacaatgttctttgtcaccaaaagatctttacccatgctgttccttctgaatgaaaggctttacagtcagccctctgtgtctgtgtgatcacttccttggagtcaactaactgcagatcaaaaatatttgggggaggggagtggcaagatggctgactagaagcagctagtgtgtgctgctctcacagaagggagacagagtggccagtaaacactagctctttaactaaacagtccaagaggacatgttgggattcataaaggaagcaatgtagtcaacataaaacagaaaaaagacaggacagctgcccacctgggattggcacagtgccaagtgaggctcccccctgcaggaaaatggtgaataagagccccaggaaaccatgtttctgccatgaacctttgcaatttcaggctctggagacctcccctgacccccttcccctgtggcctccaggctgacacagaaagcgtgtggagtgtgccactcaggcacaaatggagggccaagggtcttggaaccgtgagcactcctgcaccagcagctgtagctttgccaacaaaggaggccaggttctcacgcatacccccaggagagaggctgcatccacagtactgagaagcagacgaactacaggccttgccccaactacacctccctaggcaaagcccactggcctgggatcccaatgcagccaccccacccctgcctgagctctcaggctggtagcagctctgcaattccctggaacagagctcccaggagtaaaagacaggcctgccatttttgctgctgcacagcccccaccccaactgctatcagaatcaggagggagcaaagaggttagggactatcttgagcctccagcacagcatagcatgccttgcagaaaaagaggccacactattttccacgcaggtccctcctcctgttactcctccttgggcagggccttcagacttgcccccaacaagcccccctccctgctcccacaccccaagcacagtcaccccacccccactgagctctcagctggtagtagctctgcacttccctaggatggagttcccagtggcagcaggcaggcccgccattttttgccactactgcagcccctgaccctactgccctctggcttggaatggaaagaagagcttaaggactatcacaggcccccagcacagcacagctcctttatagaaaagcaaccagactgttttccacacaggtccctgtccatgtgctactccttactacacagggcctcctggactgggcccccagcacagccacccagcccccgcctgatcagtcagtggcagctctgtgtttgcctggtggggaaatcccagagacaaccctctgccattgcggggcttcagcggtacggccctagctgcccttgggctgcagaacgaacaaagagcctggttgcttcactggtacctccagcatgtcgcagccaccacagggagaggaaccagtctctcttccctatgagcccccaccgcctactcttcaccatgtagggcctctggctttggcccccagagcagctgccccacccccagctgaatattcccattcgcagtggctctgcatttcccaggggcggagctcccacaggcaactgacagctcctctgccactgccactgcaatggtactgcccttgctaactaccctcagactggggaagaaagaaagaccctgagtgccttactctcacctccagcatgcagcagctgccctatgaagaggctagtctgtcttccctgtgagcccccaattcccctgctcttcaccaggcagggcccccccagcttgggcccacaacacactgggatgattattctgatggacaatggctatgtatatccctggggtgcaaccaaaagagacacatgaaaagccctctaccactgacactgccaaggtccccctctctgctacccccaagacggaaagagaacaaaaagtctggcttgccccagggctgcagtgccaagcctgggagtaccaagctgaggtctgcagcactcaagtgggagaggagcccacaccctcctctcccacttgagaggaggctcacttggagcactgagaaggtacatgactgcaaatggaaggaaatacaaaggagccacagggctgagcaagagcctacctactggccagtatgcttaaacacatcacagcccaaacttcaacaccaaaaatactttgctaatataccgcctatgaaaacacagacaagaattcagccacaaatagaccaggtgtggtggctcacgcctgtaatcccagcactttgggagacagaggcaggcagatcactcaaggtcaggagttcaagaccagcctggccaccatggtgaaaccctgtctctactaaaaatgcaaaaattagccaggtgtggtggcacatgcctgtaatcccagctactcgggaggctgaggcagaagaatcacttgaacctggaagatggaggttgtggtaaactgagatcatgccaccacactccagcctaagcaacagagcaagactctatctcaaaaaaagaaagaaaaaagaattcaacagagttggctctctgaaaacatccagaaatgaaggcaagtgactacagtcaagttacaccatgattaaaggaacattagcgcccacacagatgagaaacagccagtgcaataactctggcaactctaaaagccaaagagtctccttatttacaaatgaccacactagctccccaacactgattcttaaccagaaggaaatggctgaaatgacagacacagaattcagaatctagatggcaattaagattatcgagattcaggagacaactgaaacccattccaaggaatctaaggaatccagtagaacaattcaaaagataaaaatatgaaaatagccattttaagaaagaaccaggccaggcgtggtggctcgcacctgtaatcccagcactttgggaggccgaggtggatggattgcttgaggtcaggagttcaagaccagcctggccaacatggtgaaacccagtctctactaaaaatgcaaaaattaccaggcttggtggtgcatgcctgtaatcccagctactcgggaggttgaggcaggaaaattgcttgaacccaggaggcagaggtagcagtgagccgagatcgcatcactgcactcctaggcaacagagtgaatgagactcagtctcaaaaaaataaaataaaaataaagaaaagaaagaaccaaactgagctgatagacctgaaaacctgcctataagaatttcataacaatcagaagtattaatagcagaacagatcaagctggggaatgaatctcagagctcaaagaacagttcttcaaattaactcagtcagataataaagagaatttttttaaatgaacaaaacctccaagaaatatggaattatgtaaagatgccaaatctatgactcattagcatccctgaaagagaagggtaggtcatatacaaaggaaactccatcaggctaacaacagaactttcagcagaaacactacaagccagaagagatttggggcttatattcagcatccttaaagaaaagaaattccaaccaagaatttcatatgcagccaaactaagcttcataagtgaaggaaaaattaaatccttttcagacaagcaaatgctaagggcatttgttaccaccaggtctgccttacaagaggtccataagacagtactaaatatgaaaatgaaagaccattactgatcaccacaaaaacacactcaagtacacactctattaacactataaagcaaatataataatacaatcaagtctacataacaatcagctaataacatgatgacaggataaattccacacataacaatattaatcttgaatgtaaacaggttaaatgcacctcttaaaaagcacagcatggaaaacgggataaagaagcaagacccaactgtatgctgtcttcaagagaccatctcacatagaaggacactcacatgctcaaagttaagggatggaagaaatctatcaagcaaatggaaaacaaaaaggagcaggggttgctattcttattccagacaaaaccaactttaaaccaacaatgatcaaaaaggacaaagaagggcatcacataatgataaaaaggttcaattcaacaagacttaactatcctaaatatatatatatgcagtcaacattggagcacccagattcataaaacaagttcatagagacttacaaagagatgtagataaccataaactaatagtaggagacttcaacatcccactgaaagtactgggcagatcactgaggcagaatactaacaaagatattcaggatctaaacttggtacttgaccaaatgaacctaacaaacatctacagaacactccactcaaaaacaacagaatatacgttcttctcatctgcacaaggaacatactctaaaactgactacacactgggccataaagcaattctcaacaaattcaaaaaaccaaaatcataccaacctcactctcataccacagcacagtaaaaacagaaatcaatactgacaagatctctcaaaacatacaattaaatggacattaaacaatctactcctgaatgacttttgggtaaacaatgaaattcaggcagaaatcaagaaattatctgaaactaattaaaacaaagatgcaacatatgaaaatctctgggacacagctaaagtagtgtcaaaagcaaagttcacagcactaaatgcccacatacatcaaaaagttagaaagatctcaaattaacaacctaacatcacacctagggaacctgaaaaacaagaacaaaccaactccaaagctagcggaagaacagaaccaaaatcagagctgaactgaatgaaatagatgagaaaaaccatacaaaagattaacaaaaccaaaagttggttctttaaaagaataaataagattgatagactgctagctatactaatttttttaaaaagggacaagatccaaagaaacacaatcagaaatgacaaaggggacattaccaccaaccccatagaaattttttttaatcctcagagaccattacaaacacctctatgcacataaactagaaaacctagaagaaatggataaattcttaaacatattatctcccaagattgaaccaggatgaaattgacaccccgaacagacaaataacaaacagtgagtaaatcagtaataaaaatcctaccagctagaaaaagccctggacaagaaagattcacagctgaattctacgagatgtaaaaagaactggtaccaattctactgaaactattccaaaaagtcaaggagggactccttcctaactcattctgtgaggcaaacatcattctgacaccaaaacctggcacagacataatgaaaaaaaagaaaactttaggccagtatctctgatgaacatagatgcaaaaatcctcaacaaaataccggcaaaacaaatccagcagcacatgaaaaagctaatccaccatgatcaagtatgctttattcctgggatgcaaggttaattcaacataggcaaatcaataaatgtgattatcacatgaacagaactaaaaacaaaaactacataatcttcacaagagacagagaaaaggctttaggtaaaattcaacatctcttcatcttaaaaaccctcaacaaactaagcattaaaggtacatacctcaaaataataaaagccatctaaacaaacccataaccaatatcatactgaacaggtaaaagctggaagcattccctttgagaactgcaacaagacaaggatgcccactctcaccactcctattcaacataatattataagtcctagccagagcaatcaggcaagagaaagaaataaagtgcattcaaataggaagaggggaagtaaaatgatctctctttacagatgatgtaatgctatactagaaaaccctatcgtctatgcccaaaggctcctagatctgataaacatcttctggaaagtttcaggatacaaaatcaatgtacaaaaatcagtagtatttatctatacaaataatatccaagctgaaagccaaataaagaaggcaattccattcacaatagccacacaaataaaatacttagcaatacagctaaccagagaggtaaagcaattctacaatgagaattataacacactgctgaaaaaatcagaagcaacacaaacaaatgaaaaaaaaatattctatgctcatggataggaagaatcaatattgttaaaatggccacaatgcccaaagcaatttacagattcaatgctattcctatcacactaccaatgacatttttaacataattacaaaaaaccattctaaaattcatttggaaccaaaaaagagccaaagagtcatagcaacagcaatcctaagcaaaaagaacaaagctggaggcatcacactactcaacttcaaaatatactaaaaggctacagtaactaaaacagcattgtactggcacaaaaacagacacacagaccaatggaataggttagagaatccagaaataaagctgcacacctaaaactatcaaatcttcaacaaagtcgacaaaaacaagcaatggggaaaggacttcctattcaataaatggtgctgggataactggctagacatatgcagaaaattgaaactgaacccctgcctttcaccatacacaaaaatcaactcaggacgcattaaagacttaaatgtaaaacctaaagctacaaaaaccctagaagaaaacctaagaaataccattctggacatgggcccaggtaaaaacttgatgaagattccaaaagcaaatgcaagaaaaactgacaagtggaacataattaaagagtttctgcatagcaaaagaaactatcaacagagtaaacagacaacctacaaaatgggagaatatatttgcaaactatgcatccaacaaaggtctaacatccagaatctatcaggaactcaaatgaacaagcaaaaaatgacaacattaaaaaatgggcaaggatgtgaacagacatttctcaaaagaagacatacgtgcagccaacaagcatacgaaaaaatgctcactatcactaaacactaaggaaatgcaaatcaaaaccaacatgagataccatctcacgccactcagattggctattattaaaaaagctaaaaaacaacagatgctggtggttgtggagaaaagagaacgtttatacactgctggtggaatataaattagttcagccactgtggaaaacagtctggagatttctcaaagaacttaaaatggaactaccatttgattcagcaatcccattactgcatatattcccaaaggaatataaattattctaccatgaagactcatgccctcattgcggcactgttcacaacagcaaagacatggaaccaacctagatccccatcaatagtggactggataaagaaaatgtggtacatatgcaccatggaatacaacacagctacaaaaaaaaattagattatgagatcatgacctttgcagcaacatgaatggagctggaggccattatcctaagtatcctaataccacatgcaaaaatgtggcatttggttttctgttcctgcattaattcatttagaataagtgggagctaaaccctgagtatacatggacacaaaaaagggaacaatacacactggggcctacttgaaagtggagggtgggaggatggagaagattgaaaaactacctatcaggtattatgctgatgacctgggtgacaaaattatctgtacaccaaacccctgtgacatgtaatttacccatataacaaacctacatatgtaccccctaaatctaaaataaagttggaaaggaaaaaaaagaaaatatccggggggggaacaataaaaataagaacaattaaaaataatgcaaataaaaaacaatataacagctattttcattgcattagatattgtaagtaatctagagatgatgtaaagtatatgggaggatatgcataagctatatgcaaatactacaccattttatgtaagggacttgagcatccacagattttggtattctcagaggatcctggaaccaatccccaaagatactgagggccaactgtactctaactttagttcaacaatccttgcctcagagaagccattcctgaccttctagaataggtcaaattcccctaattatttaatagcaataagagcttctcatttttataatgcatattttggttgcaattttatatgtgtgtgattaagtctgcttgaccccaccatactgtattactctgtgagctccagaaacttcgagttcggttttttgttgtttttttgtcaccattctacctcctattactagcagtgttacatatgtagtatgaataaataaatatttcgtgaatgaatgaacaatctgaatacttaagaatttttcctggccgggcatggtggctcacgcctgtaatccagcactttcagaggccaaggcaggaggaccacttgaggccaggagttcaagaccagcctgggtgacacagtgagaccttgtctctacaaaaaaatataaaaaattagtcacgcagggttaatacctgttgtctcagccacttgggaggctaaggcaggaaaatcattggagcccaggagttggagatggcagtgagctgtgatcatgccactgcactccagccgaggcaacacagcaaaaccctatctcaaaataaattaatttaattaaataaataaataagtgtcttaaatgtatctccacatttccctcaccctgcctaccacttattcaaatttccagggagggggtctcctgatgtatgtttcaaatttatttttaaaaatattctgcaggtaatactgataccatctccatttggattattaggccaaagctttctaattaaattgctggtattaacaattactcaaactgaaagcatactgcctaagagaaaatagtcgattcactttgcaaattcagttataaagtgaaagcaagcatcaaagtcgcataaaaagccaaaggaatctgatcaagaaatattccaagatatgaactgagagtcagaacagatttatctcaatgatctccccaactatggcacaatgtaatgactaaagaatattttactgcatatatccaatatactcagagatgagtaggcaaggtgtgggtatcaaaacaaatacaaaatatttagtacccactcagtatctgttgagttacttaattagctaaatgaatgaacacagtatggtctcttccctcaaaagttttacaattgaattgaaagacaaatttttaaactctactcttatagttgcagagaaagataaaattaacatcagaaagtttaaaatcattaaatactttatttaagaacagtttgtttaccaagttaggacagtggttatgatttctcaatttacacatattccttttgaaaatcttagaaaaaatgtttcaccaatgttaaggtacaactcttgaatatgcagcgtagtcttctctctttattctgaataacagaagcacgtaaattaaattatcctctttgcacaattattccccccaaaactaatttataacatataattatctccctaaaaagcagttacaaaccataaattgaatatgaataaaatatgaaaaagagcacaaattttaaagccctccatgcaaaaaaaaattaatacattggctttacctataaaccttattttgttaatgctaagcacagaacccttatgggctcataggagtcagcaaacagctacagatgagtcttcttgttaagaattcattcaatgcttctcagaatagcagattttaaaaaatgaattcactgaggttcttaaacctctgaacataaggcaacagttcacaactgatttcagaaatagaaggtaagtattaaattacaaattctactaggtcagtgggagtgggcggattcacctggagtggagcagtgaaggtttattttacctctttcaagatctctccatatattccaccagtttgagataggctgggggaggaggtggaatagcttaaaaggttatatttcttattttaaagtataaaaacatacacttaaaggctaaacctatctataacctacatcttaatgtcagcaaaacatactgctttctacccaaatcaccaattgaatcagcctcgctcatgatttcagagcataaggtgtccagagaagaaaactcaagactgaatgggctgccataatggggaagtacaggtagccaaaggccagcaattgagacagcattagagaaactatctactatgtctgaataagctcccctaccttacaagcatcaactactacattgaaaccattctgagtgctgcatttcctatatgtgcctagacttggtaatgcctgataaattctgtatattaccacgtcttgcatttaatagacaatttgtttaatgatactaactttactcacacttaattgactttctcatatcctgagattaatctaagaaaactatttcaaagataaatttaaaataatttttaaggaacccagaatttttatttagaacactgctttgacttttgttattactttgtatttattagtatatcctattcataattttgcactgactttcaatataaaattaaatctctgcttacacaaaataactgtcagctccaaatcaacatgaatggagtgacactgaaaatatcatactattcccgataaaaagagtttaatgcaaaataattattacctggtatttcacattcggtttgtgtctttatctctactcccaggcaaatattctcacttaagaccagtgccttcactgcttcttgtaaagacatttaatttaatgttattgcatatttatttattttttatgcttattcatacagaatttattactttctagaattttgggataagaatcataatcactaatgcaaaatactcttaattttttaaatgttgtatttctcgtttttaaatattaatagttcactattctaagtttttcatgaataaaaaacacatcctaagttcatgaaatctgtgcggttcactactgtaccaggtattaaaaccttaagggctaatcctcttcacttatgagaatttctcaagaatgagtcaaatgcgccacatttaaatttgcagattattttgtctagctgctcaatcaagagaaataccactcaaagaaatcaattctaaattcatgtctttaatgaatactatgttttgcaacctgtataaaaactgatcacccaagcacatgcaaaaggaatatagttatctttagtgggcttgctaaagtattgacaactaatcagtgtcctctaaatactcttattttggcaacagcccacaaggttaacttttagaaaattcagcttgatacaagaaaataattcatcataattagacaatataatttttccacttttgagacaaaatatataaatcaatacttgtttatatgacttgcaaaatgtctatacactaagattgctacagtctatgaggtaaccaaaggtaagtgatacacatcctttagaaaacacaatttgtctggggggatgattgcacatgtatttaaatatgttaaaaccactgaattgtgtattttaaatgtgtgattatatggtatgtgaattgtatctcatgaaggctttttaaacaaaacaacactgatgtaacttagaccaaaaaaaaaaaaaccacaatttgtcacacattgttcttttgagacatatttttataaagacagaaattaacatttgtagcatcagcaggtttgattagcacatgttacccatgtaggtataattgtctaatcagtagccaaagtgtgcccttgatgctaatcacccctataactgaataatctgcaaattacaaaatgagttgtaatcccccatccactaccagaacatgccctgtaatatacggtgattctaaaagaaacacaaccgcatgtgccacctcaatagtttctccaaacctcccaagaggaatatttttctttaaatgttcttctttcaagtctttcgtcatatctgtgtgtacaaatcctaaaagagaaatgtttgtttagttgaaaagggtacacactaagacatctgctgaatttcaaaaaaaataataaatttgtttctgaaaattttaatttgaaattatttaaaaaaaaatttttttttgagacagggtctcactctgtcacccaagctagaatgcagtggtgcaaacacgactcactgcagcctggacctctggggcacaggtgatcctcttgcctcagcctcccaagtagctgggactataggcatgcaccaccacacctggctagtttttgtactttttgtagagttgggccaggctgatctcaaacttctggactcaagggatcggcccacctcagcctcccaaagtgctgggattacaggcatgagccaccatacccaccctataatttgaaattattaataaaccttgtttatataaaatagttttgttggccaggtgcagtggctcatgactgtaatcccagcactttgggaggccgaggtgggcagatcacctgagggcaggagttcgagaccagcctgcccaacatggtgaaaccccgtctctactaaaaatacaaaaaattagctgggggtggtggtggacgcctgtaatcccagctactcaggaggctgaggcaggagaatcgcttgaacctgggaggtggaggttggagtgagccgagattgtgtcactgcactccagcctcagcgacaagagtgaaactccatctcaaaaaaagcaaaacaaaacaaaatagttttgttagtaatcaagacaccaagcctacatttttatacaatttaactcaatgaatatttattggacactaaaatatctgacccccaagtatctggcccacctagcaaaatataagtaggtagacacaaacatgaataaaacaaaattccactctttggggaacctatgatttgtggaggaaatggtcacttgcacacccgattataacgtaaagaagtctggtgaatatcctgatagaagtatatataaaatatcatagaatacattaattttcacttaggtagggatagaaaagtagaaagtagtgtcaagggaaggaaggcatcacaaaagtggtcacatgaactgatttggtagctgatgattagaaaggccagtatttcccatatctggattttaaaatcttacggtcatatccaattctgatacaagtaaacatagaaaattcaaattcagtaaagcctgccaagaaaatgttctaaagaatgtattaggttctacagtataaagaactaactacataatatataaccaaccaatcctaaataactacaaatacataccagggagaactgtagacttatgaagaaaatcttacaagattaatacaggacatacaaatacgtattaataaaatgcttagcccatataatcagtatcctgtatattactcaatcatttgggtttttaaaaagaaagcaatattaatcctcatgaaaagaatagaaaaaaatttttaaggtcatgaaaaatagatggactaaaacttcaacatgacgtgtgaagtaaacatttaatgtgcaatctcaaaaatacagttttcaaattgcctgttaaaactaaatcatttatagctcaaactatagataaacctaaatatattaccttttaaagtaccataataaatgtgaagtaaacaatgaattaagaattaacattaggccattggtttattatgcaatactatgtaattacttaactttcctttctttaggtttgcagttataaatatctacgcattttcttaaaagtcttgtgaaaaatattcacagatttgtctatcatgaagcttatgaatgacactttcattaggaaaaaactgaaacaagctgaatgtctttcaataagaaactggttaaataagttatgatacagccatacaacagaataatgcaggtattaaaaataatgctatatgttctcacttgtaactgggagctaaagaatgtgtacacatggatgtgatcacaatggagattcagaagggtgagagggtgggacagaggtgaataagaaattacctaataggtacaatgggtgttattcaggtgacagataccctaaaagccctgacttcccactatgaaatctatgcatataaccaaactgcatctgcacctgcattcatttgtatttatacaaataaatgaataagataaaaataaaaaataaaaattatgctatagaaggatacttaaatctgaaagtaacatttgtgtataaaatgtaggttacaaatgaattaagttataccactattaaaaacacaacaaagaacttatactaatgactgaaaaaagtactatataccaaaatattaacagtgattatcattagatactagaattacaggtaatgatttttattttctttatatttttctgctctttccaaactgtctacaacagatatatatattatttttgtattcagataaaaagttgttgaaaaaatgcacacagtactaccttcagatagtctgtaatgaaggcctggaataacaaaactaattttgtattatgtatgtttcactgtgaaattacacagtgaaatacagtcttctctgccataacatcttaccacatttattttaaaagtcagcaatatttccttcatatcctctcatctttaagaagaatgagaaggccagaaggaatgcaagaataaaaggagaagcagctaacacagatattgatactagcctctgcagaatttccaacaaactataaatgaaacttaatttacagtgaagagccacaataatcaacaggcaatccaatcagcttaagaacaatatcatgggggttctcgctgtccaaagttttctgtctttagacacatgtattttccttttttttttttttttgagacaagagtctcactctgtcaccaggctggaatgcagtggtgcgatctaggctcaccgcaacctccgcctcctgggttcaagcgactctcctgcctcaggctccccagtagctgggactacaggcacacgccaccatgcccagctaatttttgtattactagtagagacggggtttcaccaggttggccaggatggtcctgaactcctgacctcaggtgatccacccacctcagcctcccaaagtgctaggattacaggcgtgagccactgtgcccagccaacaaaagtattttcaaaagtgcctcagagagtatcctaggaagaaaacctcatctcacacttgtaataaaagcagaatgaataaaaattgtcaaaaacatgtaaaagttcatgttatcttctcaaagatagacacaattatcctttaagttcttttcaaactctagcaaaattagcatagaatacttcccagtaactctcacaaactgtcagcataaaaatcgatgcattttaacccaaaaaacaaaaacagaaaaacacaataaactacagtagaaatggtttgcaagaaagaccttgtgactatgcaaatcccaggctcaacttctgactctgctggcctggccttttctcaaaggcagtattttgtggttaaaaaaaaccactggattaggacacattaaactagattctgttccctgctctgctgatactattaaagctatcacccgagaaaagtcacgtgctaagaccagctcggtcacggagaccttaacacagcagcactagaggaattaaagacacacacagaaatatagtgtggagtgggaaatcaggggtctcacggccttcagagctgagagcctcaaacagacattcacccacatatttactgacagcaagccagtgataagcattctttctatagatgatagattaactaaaagtattccttacgggaaacaaagggatgggccgaaataaagggatgggtctggctagttatcagcagcaggagcaagcccttaaggcacagatcgctcatgctattgtctgtggttcaggaacgcctttaagcggttttccaccctgggtgggccaggtgttccttgccctcattccggtaaacccacaaacttcagcatgggtgtcatggccatcacaaacaggtcacggtgctgcagggattttgtttatggccagtttgggggccagtttatggccagatttgggggcctgatcccaacagtcatgtactatctgcaactgaatgaccatttctgtatcataaaatgaatgtaataggtggaaaatgacagatctctgaggtttcttttctgttttttcttttttgctttttttcttttgagacagtctggctctgtcacccaagctggagtgcagtggcacaatcacggctcactgcaacctctgcctcccaggttcaagcaattatcctgcctcagcctccccagcagctgggacaacaggcgcctaccaccacgcctggctaattttttttttttttttttttttttttgagacggagtttggctcctgtcacccaggctggagtacaatggcatgatctcagctcactgaaacctccgcctcccgggttcaaacaattcttctgccttagcctcccgagtagttaggattacacgcatgcatcaccacaccaggctaattttgtatttttagtggagacagggtttcaccaggttggttgggctggtctcaaattactggccttaggtgatcagcctgccttggtctcccaaagtactgggattacaggcgtgagccaccatgcagcctggcctgaggtttcttttagccctacaacactacgattcaaagattaaaagtatgcctcattaagtactcttcatgacaacttgacttgaactttaggaatgtaagttcccttaaaagggccctcagttcttacattggtaggtacatagaggttagaatacttccaattcaagaagcactaacgctaacctgggttttcatccatgctgtgttgaaaggaactgatcagcccttcttctgggtggatgttagttctgatatgtttgtcctttcggagacaaaaagtaaggccacaaaagttgtgagtgaccatttgaacaggttttttcacctcggggaaaaaagcagatctagaataaggcatgagatactggaaggtctccaagccttagacaggcaaggagacctaagcagtgagacactttcagggacaatcccagtgagatggaaagatgacctctaccacacagacatgggctgacatccttctttctgcttgtattactttctagtctgtgctctctctccttggccccaaaggactctcccccatatcatcctttcatttcatttgtaaaactctggaaattttgctctactcccctttttgctaggtatacatttacaatgcctttcacactaggctataaacattacaaactaccagtaggtgccactgtccaacaaataatgctactgcatctcctggagagttagacgtttccagtttggaggacagacatgtgatcccccaaaaacaaccaagtaagctagatatggaacagataaaggctaacatcttgaagcttttaataaggtcttgttaaatgttatagcctggattcatctctgctatagtctatgtctatgttaggtcagatctgtacaagagagagtggtgccctctgaatccaacatgattacaagaagtccagaacaggaatgatgatgttcagccacccacctcgaatgaaaagtctccctccactgctcaagcttagaagataagggtgtgatttatttagggaaagcttgccacaatctctccccagacctatgaatggatacttggaataacaaatatcaggggacagctgctagccatcactgaactctgcactaaaagtaaagtgggtgagagaggccaagttgaaaggaagggatgaattcaccaatgctggtttttcctctttgattatgttattttctatggaggacatgaacatgtccaaagagcctctcttcattttctgtagctttttaaaaaatttataaactttacatttttgaggaattttaggtttacagaaaaattgaacacaacgttcagatagatcccatgcacccccttttcacatcacccccccctttccatttcccattactaacatcttaccttagtgtggcacatttattacaactgataaaccaatattgatacattattaagtaaagtccatagtttacattagggttcactctttattttatatatttatgtattcatttattaataccattttgtcttcacaagctaagggttcactctttagactgtacagttctacaggtttggacaaatgcataatatcatgtgtccaccattacagtagcagacagaatagttttactgccctaataatctgtctgtagctttttaaaactcatgtatctgtccccactttatcagaaattaaataaaatttatcagaaattaaattaaaaatgtaaagctagtctctaatgataaattactctgggctgtatggaacttccatgtcattttatattaaaggttatgaaccacgtgatcttcatttataaatatattcacaacccaggacatgacatataaatggtctcttaggttccatatcatgtatcacagacctgaagagagagattaatagtccttaaacaactcacacacccttcttactacttgtattactttccggtctgtgctctctctccttggccccaaaggactctcccccatatcattctttcacttcatttataaaattctggaaattgtgctctactcccctttttgctaggtatatattaacaatgcctttcaaactaggctataaaatttacagactaccagtagatgccactgtccaacaaatgatgctactgcatcacctggacagtcagaggtttccaattggctacaaagttatcacttcttaactcgacgaaaagataactgaaatgacaagcattaaaccaatttagagcaaagatacttctagtttagttccatatatgtgattaaaaacccagttcaatttttataggaactctttaggaacagggacactcttgctcaaaaaggtaaatgcatggctcctgcccaatgaggatttatatttgataaactctaaagatataggccaggtgtggtggcttatgcctgtaatcccagctactactgaggcaggaggatcgcttgaacccagaaggtctaggctgcagtgagccaagactgcaccactatactccaacctaggcaacagaatgaaaccccatctcaaaaaaatttttaaacaatttttttaaaaagattatatcctttatcgatttctgactagctataaactataaatagaaacacctcatttccatatccctaggtcattattttagttttcaacatttttatatacagcagagcctttatatttaaaaaggcatcaggattttagcctatcactagtactaacaattgtgagatggggcactatttgatgtatctgccagataagatgtccactctttgatgtaagtttctaggactcaaaaagaacaaaaacaacccaacacttttctaagggagaagaaataaggctcttaccaaaaagctaaaccaagattttaactagaacaaatttctatgtcttaatattatatttgtagagggaagcagagtgggaaatcaacttcattccaaacagcacataagaacacttagaatatcttctctgagtagctaacaaactcatgcaaatctttgtcaacaagattttctccaagtagtaaacataaaagctcttcaacttaaaaaataaagtactgaaacacttaaggtatcctgtagaaataaacataatactatttgtcaaaattaaaaatgcacatacctctgaagcctttgcagttccagtcccaagattacactcatatacttgcaaatgtgcaaaataaactccatacaagtattgtcactgcatcattagttgtaacagaaaaagttcagaacaaaactaaatgtccatcaaaaggcaacaggttaaataaattaggtatacctttaaaacaaacatcattttctgttttcattcagtcattaaaagtgacataacagtcacaaaacaccaaatattacatgattcaatttatatgaaatgtccagaatatgcaaatctgtagatacagaaagtagtttagtgtactggggagattggaaagaaatagggaatgaatgttaatgggtttaggatttctttaaggatgatgaaaacgttctaaaatttactgtggtgaagattgaacaattctgggactatactaaaaccactgaattgactgaattgtaaactttaaatgggtgaattgtatggtatgtgaattgtatttccacaaagctgttatttaaaaaagtgaagcagctctatatggaataacacagaaacatcaccaaggtatcttgttctatgaataaaggaagatacagaaagctgtgaattgcatgatacaatttgtgttttcttacactcatgcccagcatgctttattggcttatatatgaaatacaaaagaaactttgtagttaacagcaactacttttaagtaactgaatgtccagaggagaaaagactctttatgcctttttgtacttttgaatttcgtactatatgtattatctattcaaaacacatattttttaaggtaatacagccattacagtttccatttatcaaatattatttctaatattcaatatcttccaatcagtatgatttcccatgaacagtttattttatatttaaagtaataccaaagattagcagctattgatctttaaaaagtcaacagtattaggcaatgaatcgcagcctaatttattattttccttgttccttgcttttcctgttataatttgcttttaaactgttttcctgctaattggaaactccatttgaaggtgaccaggaaaactgacataaaaggacacatatttgttaactgtgatgtttgttagctgtgttacaagatctgttgaagaatctggttgaaattactatctaaaataaagttggtaagtaatccacagaactgatttaattctactatttcaagttgcactttgcttctgacaaatgatgcatattcataccatcaaatctgctaaatatacataaaggccactctattaaatggccacattttcagctacaggtttttatctgtagtataaattgcactggaaatccataatatataaatatatattatgctctataagggttgtatgctcaacaaaaaaggggagtgataaataaaaccaccactttcaaaaaaaaaaaaaaaaaactgcactggaaagtaaaatctttaagaaagaaagactacaaccacacttccataacaatcttaaaacttccccttagtatgcaaactggattcccactatttagtctactgccttgacaactatttactctaaactagacaaaattaagcattctttccttcttcaacatttctatagcaccatatatgtacctctattttatattcgtcatatgacactgcaattatttgtttacatgtcagtctttttcactatacttagctccttgtgcagaaatatcttattcattcctgtaatttggggagctagctcagtccctacacgtaggagacatgccagaaagtttgctgcatgagttattgttagctaagtacacttccattccccgaaaccattcagcttttgtattatcatgaactaaaattaacccttcattacccacagtattccaatcctgaaaagagaaggaagcaaatacatgtagttccaaaccacaaataatttattccacagatagttcatctaggctaacgctaaaaatcaatcagcttgcataaagcatacacaaagagaaaacagtgctaagataacaacaatgctgcttctggattgttttttctttttctttctctccctactcccagcaaatagatgtatctgaaccacagtcacttatcaaatattcatagatttagaatgtctgaatgtagctagttgctatgagaaaaaaaaaaaagaaaagaaaagaattgaaataaagacacactatagaccaaaagggttaataggatattttgataaatccctgatacctgctggctcaacttcagtgccaaagaaaacaccaactgtaaggtccaagctggagccattagtgaccggaaagggaaaggtagcaaaggtctacttcagccctctctttcttacaaaggaccagcaaaccaaaataaactgccttttcttatataggtgattaattcttaagtacctacagtaggctaggacaaagattccatggctaactggcagaggtagataaaaacacttgtgttactcaaaaaccaagtaaatacctaatcaaaatttctagcacaccagctaattagtgatcatatatttttgagttttagcacctttttattaccctcttcattaatccaggcaattttatcaactagtaccctggcgaaaggcaaataatggaaaagtaaaaattaggaaaatgggaggttccagatagtttagacagaccatagtagtaaaaggacaaaactatctaaagtttgtgtaatgatataaagaaaatctaaaaagaattttttttttaatttttatagagacagggtctcaacagggtctcgctctgtcacctaggctggagtacaatggcatgatcatagctcactgcaacctccaactcctggactccagcaatcctcctgcttcagcctcccaaatagctgggactataggtgtgcaccaccacacccagctaatttttttttttttttttcggtacagacagcatcttgctatgttgctcaggctgatctggaactcctggcctcacaatactcctgcctcagcctcccacatgagctaccatacctggtaggacattatttttaagctcccattaggtggaaatcaaaagacaaagcttttagtaacagttcttccataaactagctgtgtaaccttaggcaagtcactctgaatcccaggtacagttttctaatctacaaaaatgactggaaaaaattatttctaagaccctctccaccttaagttattccactagtgcaaaatttaaaaataaagactcttatggtttggatgtctgtcccctccaaatctcatgttgaaatgtgattcccaatgttggaggtgggcctagcgggaggtgtttgggtcatggaggcggattcctcatgaatagcttggtgccctccacatggtaaataatgagttctcactgttagttcatgccagagctggttgtttagagcctgccacctcctctctctcttgctcctgctatccccatatgacttggctgctacctctttaccttccgccatgactgaaaaaaagtttcctgggcctcaccagaagctgagcagatgttggtgtcatgcttgtacagcctgcaggcccgagagccaaataagcctcttttttttatgaattacctcagacagtcctttagagcaatgcaaacaggctaacacatagactttatatagaatatgaggtacaaaaaatttttttgagtcccccagttcattatttgattcttttcacaatcattttacaaactattctacccagatgtcaattactaatgttccaaataatggcttccctataaaacaataatcataatcaagttattttaataaagttttcactaacctggtgcaactacattcactctaattttctttcttgctacctctttagcaagagcacgtgaaaatccaactaatcctcctttactggcactgtaaacggactggccagagttgccttttaagccaacaatgcttcctaggacaaaaaaaaaaaaaaaaaaaaaaaaagcgtattaaattcaattaatggggttacttgaaaatttagataatttatagtaaacaaaaaggtaaaacccacttcaccttgtcctttgttaaaattagaaattctaaccattgtcatcagtcatttacggaagatttaagagtccaagtctgctccagatacatacagaaaatagcatctgaaagcagctgatacaaaactgccaatgcaggtgcttgcgaattgattcactacgtgaaggggatgcactctaatctctgagtaggtcagatatgatgaaaattctgtggtatttataaaggcttccagcaggtagaggttaaagccagaaaaagtcagacaaaagctgactaattttatgattctacaacacagacataaggcagaaagctctcgttttcaccctaaaaactagttcatttgaagctaaatctcactaaaattgaattacatgcataactcattttattgttctgctttattgtgctttgcagatattgcattttttttttttttttttaacaaattgaaggcttgtagcaaccttgcaacaagcaattctattagcacttttccaacaccatggctcactgtgagcagtgctcactctgtgtctctttgtcacattttggtaattttcataccatcttaaattttttcattattattacatctgttataatgatctgtgatcagtgattcttgatgtttactgctgttggggtgccacaaacaaaatattactgctcactgacaatgcatctggtcaccaaagagctctgatggatatgtacaaggagattaatgttgttttcgtgcctgttaacacaatatcctttcttcagctcatggatcaagggataattctgactttcaagtcttatttaagaaacattttataagtctatagcagtcataaatagtaattcctcttaggaatctgggcaaagtaaattaaaagccttctggaaaggattcaccgttctatatgccattcagaacatttgtgattcatggcaggtcaaaataccaacattaacagaagtttgaaagaagttattttaaccctcatggatgactttgtggggttcaagacttcagtggagcagaattacaagtggagcctgaagatgtgactgaattgctgcaatcttatgataaaacaaatgggtgaggagttgcttcttatgtatggataaacaaagttgtttctcaagatggaatctcttccttgtgaagatgtgaatactgttgaaagaaatgacaaaggatttagaatatcctataaacttagttgataaagcaatagcagggattgagaggagtggctccaatttttaaagatctacttgcataaaatgctatcaaacagcatcacatgctgcagagaaatctctcacgaaatgaagagtcaatcaatgtggcaaattttgtcttattctaagacttggaaccaaatcaaatgtgcaacaatgacagactggattaagaaaatgtggcacatatacaccatggaatactaagcagccataaaaaatgatgagttcatgtcctttgtagggacatgaatgaaattggaaatcattctcagtaaactatcgcaaggacaaaaaaccaaacaccgcatgttctcactcataggtgggaactgaacaatgagaacacatggacacaggaaggggaacatcacgctctggggactgttgtggggtgggggaagcggggagggatagcattgggagatatacctaacgctagatgacgagttagtgggtgcagcacaccagcatggcacatgtatacatatgtaactaacctgcacattgtgcacggtaccctaaaacttaaagtataacaataataaaataaaaaaataaaaaaaataaagaaattgccacagccactattatcagtcagcagccataaacatcaaggcaagaccctccgccagcaaagattatgacttgccagaagctcagatgatcattagcattttttagcaataaagtatttttttagcaacaaagtatttacattttttttagatataatgctactgcatacttaatagaccataatataacttttacatgcactgagaaactaaacaattggataagacaaaatttgccacattgattgactcttcatttcatgaaagatttctctgcagcatgtgatgctctttgatagcattttatccaagtagaactttaaaaattggagcctctcctctcaatccctgctattgctttatcaactaagtttataggatattctaaatcctttgtcatttcaacagtattcacatcttcacaagtagattccatcttgagaaacaactttgtttatccatacataagaagcaactcctcacccatttgttttatcatgagattgcagcaattcaatttgtgtgacttacattcttgacatattcgctttattccggtggagcagaaccaaagctacaatatctgcgagacatgcttgtactgtcaatctaaattggcaaagcttcaattatacactttttgtaaaagtgcaatttcattacattcagtgatatattgtaaactgtactgcctactgaagattcttgagtgaccacatctaatgaatatgtaataataatttttaattcaaatatcaactatatgcaaataaactcttgcaaaacagaagtggggaagtaattttctgcaccactgacctgtacttatgatacaaaaattaatcaaggacctcacaaaatttttttaaagtaattttaaaaaaagaaaacattccaaacatttctctattagaatcaacaagttcagtattagaatatttatctacattatatattgtaggccaattaataacaaaggaagagaactgtgaagtacacagagagaacagacatcagactgaagaaatgcatatggatagaggggtgtttatcagaaagaaaaatacagagacacaaaaaaagaaaaatacatgcacgaaaaaaataccaaaacagggctggtccgatggtagcgggttatcagaacctattaacagtagtgtcactaaagttagtatacaacccccaactgctaaatatgagtggcttttaaaagaaaaaaaaacacaagctgctttagcagctttgattcgtgccacgcactactgttcatcaggtcaaaaagtggtaatttctgaaataccaatgaagtgtctggcagtttaaagtagtccttcctgtagtaagattctcaatttactatctattatttacttttagctcaattctaaaagttttgcatgcataaggaggactaatgggttttttaaatacacctaaaaaaaagaagattttagagttaaacaaatatacctcaggttatcaggtgacagatacaggcctgtttgcctgcttgtaagtatccaaagtccttatctggctgtgttaaaaggcaaaggttgactcattgactaatctcttacataagaaaacggatcccttaaatttttaagagtaaatgtccaaaatgctctcatgtccccttagtttattagcatagtattctttccttttctcactttcaaaacagaaaaactctaaattctggcttgaaaaaccatttcctacatttaaaagaacagggtcacttacttttatggagcagcatctcccttctgtggccttttaaggtattaccatttgaaaataaaaagcagatggtatactattatttccaaattaccaaactgaaataaaatttcaagtcattttgcattttaagttctacaggcatatactccacagcttatctgccctgtgggttagatgaactgaaaactaggggttacttacatccattcttaaaaacagagaaattttatcttcctttaaacctctacacaagatttaacagtaacccatgaaactgctgtagacaatattatttagccaccactgtctactttaattccttgtccatgttttaaaaatcaggttcctggctgggcacgtggctcacctctataatcccagcacttcgggaggatcacttgagcccatgagttaaagaccagcctaggccacatagtgtgacctcgtctctatttaaaaaaaaaaaaattcacataaaaatcagaatgatccaatttctcttgaaaaatcaaaattgctggcaaaactgggaccacattcttgcacggcaacaatctactgaatctaagtggtggcctccaccattccatatgggctctggacaatgaagctggatatcatttatcacatggctggtactgtcatttttctagtactcagtggtgtcactcatttaacacctgcctgactcctatagggatgtgaatgtgtgattcttattttactcattaatcaattaattaaatccttttttccacagataatataaatttcattcatgtttcacaataaatcacaaattcgtggattaaatatttttatggtatggtattatgggataatcataaattcacaaaggtgaagactcacctacattaacaatagaccctccctgttgttgaatcatagtcctcatggcagctttacaggtcagcatggaacccaagaggttagtatgaagctgagataccatatcttcagtttttgttcttactaaaagaccatccctacaaaaagaaacagcatataatagcatataataacaagataaaaaccaaaaaggtcaagactaatgtaacatttttactgagagtgcaagaagtgcttcctatctgagctagaatagctagaatacctagagtcccattttgaacttggcttgagaaacattaaaataacaattgataaaccagaaaggatccacttggaagacaggttgctaccccttctcagcttgagtggcaaatattcttaacccctaaaaagtagtaacatatagccaaaatagtttgaatggcctgagcaactgccatactaagccttgtttagcaagaaaattaatatgttatctaaatattctctcctaaattcatcttttaaaaaataatatccactccatgattctattagtattaagttcacaaactggcaaaacttatctgtggtgacaaaactcagaaaacagttaccaacaaggaagtattgagaagacactaccttctggagcactggaaacattctacggctcaatatgggtgatgattacaatgttaaaatcgactcaactggacatttattatatgttgtatctcaatataaaggaaaataatttatggattgacaagttttaaaatagttttttctcccagttagaagcaaaataaacatattaacttataccaatcaaagacatattaggaataaaagttttaaatatatatataagaaacttatttaaatctgtgaccaacctgttaataccagctgcatttaccaagaaatttactcgacctaaatgtttctccagctcttcaaatgtattttgaacatcatgttctttagcaacatcacagctaaatgccaaatgatctcctacacaacaaagttaaataagaattacttataactcaaattttaaatttactcaatacacatttgttaagcatctatctaagatggcaggcctgtgctaatctagaacctaaagattaaaaaagtaatgtcatgaggcctggctttcatagagttggtctaatgaaactgggatgcgggaacaaagaggaaataaagtactactacagaaagttaattttaaaattttctttttaatcaacaaaggggggagggctttttcaagttataaaggctctgtaagattcatctaatatttatagctttaacactgaattcatgctacccaattcgacagtcttctgggttttatattccttttttgaaatttatgtctaattctgtcaggtttttgttgaattagtttctttggccctgaacgggaactcttgggtttcttctttttaagtgctacggatgcactatggcacatatattataacgactattattcaaacctgaccatcaggagagatgagacaacacaggaagctataaaaatgctaaaactacaaaccacggggggaaaaaaacactttttactaaaagcaactgttacttaccacttttaaaaaatggttaaatgccaaaaaaaaactacacttcaaaggaaaacaaagcattccctatgtaatctaccattttaatactctaaaatgtaggattgtttttaaaagctaaaacaattctttattttctgtctgaccttgataaatatgcttacaccaacactaccccatcaagcctttggaaacagtaagcgacccggggaattatactttctagatgaaaaccaatcactcatggaacacgattcaaaggaatgcagggcccaaaagcatcctgtgtctctcttactcttggttttcacccgaagacttgtgtccacaaccacctttgaaagcccaactaatggcttcaatccagtccagcaaacactgatggcttggggtgacacagtaagggtcaccactcttcccctcctttgttagaatggtaaggaatatgagcttcaagaagcattcactgacactctccctgacctataacttacagaatcttttttcttttagagagcccaatagtctcccaaccagcactgaacaggtgataccaaaccgatcaataatgttaacttaaaaatgaacagccacacctggcgtctatagtcccaggtccttgggagactgaggcgagaagatctctagagccagtaaatcaggagttggggtccagcacgggcaacataatgggaagccctctcaaaaaaaaaaaaaaaaaaccagatacacaaaaacagtaagagccacaagacgcacccctaggcctctattctccccatgcctccctgatagtaaatgaagtataattttgtccattctggtgattaaacaaatagcatcttcggatctaacgtcctatttctccctaaactcaatgaagagttatattcacaaaatgactaatccattcataataagccggaaataaaaaaccctgaagtttaaatgcaataaaaaagaatttggcagaacaaagttcaattgtccatttgcaaaactcaccaaaacaatttaataacattaaagcaaaccaggtatatctcaaaactggctggtactcaaaagggtttctctatcaaacactgctttgtgcattcgcgcagggccaaggcacggcccttgggcaaaactgaagggagccgttggtacctgcactcccacctttcctgcctgaactcctttcgacccagccctgtctccgggggccgagaactcgcccttttccctacattaaaagtaaactgttacgtggctctctcccacaacagggaagctcctcagcgttagcactagccgcagggcggagggtgcgtatagcggggcctcaaaagactacgaggtctcaaagaacaccccaagtgttcagccctcggcggcaagctgcgtggccggcattctgcgaggcatagggagatcgcgggtttctgcacgagacgcattctacccttggaacgggagagcgcctgcacgcggctacatcgagtaaccctagagccctaaaggccagacccgctctttttacaaaggagattttctttaggcgcctggaccgcggccatacaactggacaactccagtttggtacctaccgccgaggtcaccggcggcggctttggccccttccaggtttctggcaatgaccgccagtcggtagcctttccgggccattaactgggccacagctctgccaatgcctcgggagcctccaaaaacagcacacactttgtccatctcggagtcacaaactcggaggaaagagggtagggagtgggagcccctctccaggttccctcaggcttttaaacaaccgcggttccaaaaaaaaaaaaaagaaaaaaaaaggcaaaccgcaaaaaaaaataacgccgctcgacacctcctgcagccgcacaatagtaatgcaagacgccgtgaaaaggaggaagagctcgacgtcgccgcgtcgacgtcatcacgcacggactcttccgcgccacacctaacaaatacgccgacgagagctccccgccggcggaagaatggcctggagagggcctcgatgcttgctgggacctgtagtcttgacgcatgagagcaactggcgcaggcgcgctgctcggtggggaatgtacttgtggcactgagggggatcctctgtccccgctgggtcatatcagtcgggattcgagccccggtgaccaatcgacccggtttgttcggaactgacagggttgtcaagacgctgggctttccctggcaaaccaagacgacctgatcacgtagttagaacccagagaaagcattactgggcgtgagccggtcggggctccggtatttgcccttcgcccaggtgttgttttggctacagacttgatgtcctacctgttgaagaagtccccaagaatcgcacccacaccaaaacctaccctacctgttcctcccccaggttgctgtagaaatggacctctacccgcccagatgttaccattcatcgcgaagggtgtcgtgaagatgaatgccctgtcgaacatcatccagcaggaggtcaaggaattttaactgaatgattgaatagtcttgcaagatctatgaaacaagcttcggctgctgtagagaaacaaaaatgggttcctgcaattctaaataagatgtactgggtgctctgagagttaataagctaaaaaattcaatgtttgttacaattatagtgtaaacagaaagcatttctgatacaatattattttactagattcagaaaagtatgagccatggtccctaccactaaaaaaactacaacccagaactacaggactaatacacatgaaacactaggaggtatccaaaatcatacttagtaaaatgcaaaattatattaacacaagagctccgagaaaatggagatcagtgaagaatgaaggggtgcatggaaaagctggatttgagggctggatgaggtttgaaaaaaggaaaacaagagcaaaaagtctataaataagcaagttgagcattaatttaaatttgttattcctattccatttagatccaaaaaaagatttgaaatggtttgcaaaaatacatgagtatttgaatttaaaaggcaaagaggaccactgccccttctcccacaaggccagaacaataaattaggtcagtggaaaaaatacgaataaagtcatgctataagaatctatttagtattaaagaagagattcataaacttagagtttcctgccagcgaaagcaacaaaggaaatataattacaagtggtaatttctgtaagaaatcagcctcctggttatgcagcagagaagcctgagcaaaactccctcctcataggtcctcctaaatggcacactaagcattgtagtagacagtgagcttcatgaaaagaaaaagagattgtaaggctgttttcatagcatctattagactttattaaaagcaaatacaataggaagttaaacaatataagcaaacagtcacacataaaaattgtgtctttgaaacaatatatgtttgaaacaatgaggaaacaagcctgaggaaatttgggatggtgctatattatagtcagctttaaagtcaggtgccaagcattaaacaggcctttaactgcagaagtaataagataagagctgcatttaagaactattagcaggccaggcgtggtggctcatgcctgtaatcccagcactttgggaggctgagacaggaggattgcttgagtctagaagttcaaaaccaacccaggaaacacagcaagacccccacccccccgacccccatctctacagaaaatacaaaaaaaaattagctggacatggtggcctacctgtggtcccagctactcgggaggctgagttgggaggatcatgtaagtccaggaggtcaaggctgcagtgagccatgattgcaccactgcagtccagcctgcatgacacagcaggaccctgtctcaaaataacagtgttctaaaaaacaaacaaacagtttcccagtgatgtaaaaatgggtcagatcaaatttgtctattcactttcctactatacactatgcaatcttggaaagaaaaaactgttttacataaattaccaatataagggtcagcctaaatgccaactgtattcctgcaccttaggtcaaaccagagaggtttatcttttgaacagttctctccatttgctaggaaaatgattatttttttttctacacattgttattttagcaaaaaaaaatggtttttagatctatgccatctatcatgaagatcactaacacatgatatgaggtgacattcagaattctgaaaaccttccaacttttctcactgtatatatactgtaaatggataagctgggctttttattcaacacatacctcaggttaaacctcaaggttattatttattttttttccctcttaatacaatatcaccactatcccgggtgagaatacatctatcacagcacatcacccattagctgagaaggttacagcaggggaagtttctctgtaagcccctgatagtgaagtgaggatctgtaaattaaactgggtctcccctacccagcaggacattgaaggaagccattagaatgacccacctttagtctttccttctcactaaacatgccacttttgtggtaatattttaaccatatgttatactttaacttaaatccacataggatatattttctcttggctcccacaatcgaaggagaaaattccttatgtataaggactgttatacaaatttttaaatatgcatacctagtattacttttctgattacaaaaggaataccatttaattgctaacagttagaaaacataaactttttaaagtaaataaaaactcattgaaagcattgtacactttaagcgtgtgaattgtatcgtatgcaaattatatcccaatggaactgttattgaaaaagatgtaatttaaagcctactgccctgttatacgaaatttgaatctgcaactaattataagggggttgtacctttcatgaatatttttttcatacgtcaagatttataatgcccaagattccaaatatgcaggaaaatttatttataagaaatttatgaattatgattgaatattcattgagaatcctctttacaaatgcaccatactaagcacatccagcttatcagatccataattgaagcataacccttcctgccagcaagcagtctcccaggattcttcaggcagtgatgataatctgcacgacccaaattgcatgtggccagctaacttctccatacagaccatgctcttctttcaagaagaaagattagaaagctgccttagtgtggctgcacagatataacttttatgattaaaaagcatgttgatttcctcattggcattcttgtatccaatctgctgggtaatctaaattgtaaggaatgtactttttatcacttacaaaagtttatttcattttgattgggaacaaaaaatgtggcccatgagcttgttattttgttgaattggcgtttatgcctctgaggctgcccaccgagacctaaacctggcactcagttgcctaaggcagaagcatggagtttattccttccctctctcaacatcccacatccaatcagtcacaaagtcctgctgattctactccctaaataccattccaacttctacacatccatgcttctccaaacactgtcttctcaacctcgaatgctcccactgctttccctggtaacatctgatttatcattcaaaatgtggctcaaacatctcttgcaatggaagcttctcctgacccaaaggaggacatgctgatgtccttctttacccgtcctcttaccttgtatgtgtcttcaagtctgtatttcatggagttactgtgacgtcagaatccacataattttaggaagatagtgaatagattctcaaggatctgtgaacctaccaagctgaatacaaaatctcatgtgctttttagatgagtagcttcttgaaagagggtccacttccttcactgggttctcaaggggaactttcacctaaaatggttaagtgccaggtgtagtggctcacgcctgtaatcccagcattttgggagatggaggcggcaggatcacttgagcccaggcatttgagaccagcctgggcaacatggtgagacctcatcttttttaaaaaaacataaaaaataaaataaaatggttaaaaactttctgtttttaattgccaactctttgaatccagaaatgatcacattggtttttgtttccctgtttgtagcacagttcctagggcttgtgaatgctaaataaatgagttaacaaatgaatcaatgagtgaatgaaataactcacttaaaaggaatttattgctataagcaagaaccagtgtcgatacagctatgattaagatagacctggtgcctgttttcgttgggaaaataatctggcaaggaagacagacattaaacaattaatcatgccatcactatttaattccaatggtgggaagaactataaaggagaagtacaggctgctaggagggatcataactaggggcattgatccaatatggaggcctggggtcagagaaggcttcttctttcaggacataatgttctataaagtaaatgaataataacaaagaaagattgcaaagaatgataactacagctactatccattcattatgttacaaagccaactaggtgataacataatttatacatgaagaataaaattctgaattaaaaattcacccttaataatgaaagagattgttagtcaaagtagagttagtattacgcctagatgagatcacaggttggacatttcaccaggaagtaccatgggagagcataatgcctgaaattttatgaaactcttttttttttcccagccaaaaattttataatggtataaagccagctctggatacttaaaatcaggccccaaatgcagcacgcctgccaagccacatagaagaggagaactcagtgttcctgaaattagttttaagactggcctcaatcctctgaccccagcctctcactattccatttccatctctttgtttcagggccttcccccctctatccttctggctgcatagtctcacgtggctctcaactcacctgctgcatttcccagacttaagtgagcctttcccatccaggccctgcggctactcagactcctagatctgtatcagaggcacgggcctggcagccttcactgcacttgggctctgaaagacgttctcactcttgcaagtcacctgggaaagccagaatcgatactgtatggtttaacatttgaaactgacttgcaggtaatggcttctgcatttccagaaggcacccgtgtgcctgtagggatctcattttaaggatcactgctttttgtttctcatctacaggctacagagacccatctctcagtttggattttgattaaacagttatgcagagtagaaaacttgggccatacacaaaacttaattaaaataagcctccacttgggattaatgtatgttattgactgaatcgtgtccctccccgctcccccctctcctgccatattcatatgttcaagtcctaacctccaatgtggctgtatttggagatagtgcccttagggagataattaagattaaatgaggttctaagggtagggctctaatccaataggacaccagagagcttgtgctgggaatctctctctctctctctctctctctctctctctctctctctctctctctgtctctctctctctctgttgcctccctgtacaaggccatgtgaggacacagtgagaaggcagctatctgcaagcccggaagagaagcctcaccagaaaccaacacgattgcaccttgatctcagactttcaggctccagaactgtgagaaaattaatttctggtgtcgaaaccacccagtctgtggtatttttttatggcagtcccagcagatacaatgtgactgtttactttcttctctactacaggcaagctgcaaagtgctgctaagtaatatcacacagccactgctgattgtgtgagttgagttggggagaggttgttactatgagacctattccagagcagaaacaggaagattgtgaatctcatcctcgtcacttgcccatggcctgcagcatccagacccctcgaggtcctctcctatcttcttgccaaagcttactttcagggaggacttggaaattcattccctctaggtggtaaataatgtaacagcataaagtgttatgtcacctagggacatgtaaattgagccgagagccaagtgttaagctaaagggatgacaatctaacagggaaatatcatctagcatctacctgtccaacaatatgaatctactgcgagctcaggaacatccccagtatcagatgtaaagctctggggataagagggcaaagaaggcaattacctgaattgtggagctcacatgtgttgagagaaacagacaaataagcagattacgatacagtgtgataaaggctgtaaatgtgaatgaagtgctataggaacatagagcttcaggctcaggccaaataggcaggggggcatgtgtgtgtgtagacatctatatatgtatacatatatacacatgtgtatattttattataggtatacattataggtatgtatgcattattatatgtatgtgtatacatgtgtttgtgagagtgtgtaggtgggtgggtgggtgtgtaaaagtaagcccttactggccagacacggtggctcacgcctgtaatcccagcactttgggaggccagagcgggtggatcacttgaggtccagagttcgagaccagcctcaccaacatggagaaaccctgtctctactaaaaatacaaaattagccgggtttcacatgcctgtaatcccaactactcgggaggctgaggcaggagaatcgtttgaacccgggaggctgaggttgcggtgagccaagattgcaccattgcactccagcctgggcagcaacagtgaaactctgtctcaaaaaacaacaacaacaacaacaacaacaacaaaaaacaaaagtaagcccttaccaagataacagcaaatgctcattggataacttaaatgctatgtgccaagtacactgtctacttgtgtttaattctcacagcaaactatgatgtagaaaaatattgctacccttgtgtttgcaaacaaggaagccaaagcacagagatgttagattgtccaagatcacacaactagtaagtggcagaacttgtagaatttctactcaagcagtctcgctacagagccttctccccaaccactacatgatattgtctctccctcatcttcccaggaatcctgaaaatgtaccatatacacataaatccaaatctggaaactgactttagatagttgtaattgtagttgagattcttttttggctgcaagaaagagaagccctcgaaagcaattcaaatatgtgtttatgatgcagaatatgacatcaacaaaaagcaagctgggaccccgtggaactagagatgggcctcattgggagccccagggaccacagcagcacatccctctgcccccttaatgctctctgaggccgtaagagcccccttctctgctgtcctctgttttaaatttctccttcctgcagacccactttatttactaatcacacagttgaaaatggctgagccccataggacttttcagttcaagggattaaactctgactccctttgttcaagacagagaattggattggttgttaatgaggggatagattagcgcctgtggagagcagttctcgggggaggcaggttgccatgtgagtgagtggggtgctcaaaggcggaaggtgcacccgcagccaagcaccattgccacaggggctcagtgtgggcggccttattaaaggaggcttggctgggcatgtgctccccagcagatcagatacaccatacaagcagcatccccctaggggatctttgctcaaaataagctctgttttaaatgcaacatgtacaccatttagtctccttaacagactactgcctttttctctttttcaaatattattagctgagctcaatgccccatgaaatctgtaaatgttttgttccaagtaaccagtagtgagtcccagaaccagcacccaacatataataatatgaagagaaatggaagaggaggtgataatgtatgaggagagagatacgaatttttaagaagtgaaacagacaccaatcctataaggaatatgaatcagtcccctctggcaagtaatactcataatttgcttaacttactgagttgaggagtacatatttatgggtccctatataacctatgagtgggaaaaaatgggccaaaattcaccttatttttaaaaatgacatattaatttatttggctaatttactaggctagccattaaaccacaataattttaaataaatgagtataaagtagatgatccttaaccaaaactatggaatgtatcctttttcccttctactaaatagagatggaataaatcagttgaaaagaattggcttagaaggtgacagaggcctggcaccatggctcacgcctgtaatcccaacacttcaggaggccaaggtgggaagatcacttgagctcaggagtttgagaccagcctgggcaacacagaaagaccctgtgtctacaaaattaaaattgaaaaattatctgtgtgtagtggtgcgtgcctgtggtcctagctccttgggagactaaggtgggaggattgcttgagcccaagaggtctaggctgcagtcagctgtgaccatgccacagcactctagcctgggtgacagacagagaccccctgtctccaaaaataaaaaaagtgacagatgacaacatgaatacttttcattcacaacatacactctaactgtttcaggcaaaattccataaatatatataaaactggcaatatagcatcatatataactctgggtttagtctactgaatttgaattctggctctaccacaagctgtgtaatcttgggcaagttattaaactctctgggttaagatttctttatgcaaaaaatagggaaaataatactggcatgaggttattgacagccataagataggttgatcctatataaaatacttagcacgatgccatcgccttacaattattaataattagtagcacctcctttcaataggaaataggcattctggacttatgcatcagacagccatagtttagccatcactattgagagacttgccttatattattattctggtttctcaggtcagaaaacattttcttctgtttttgtttttcttctgatattccttacttcttgtatctcacacaaaatatgtcagtcacaattctgggtctggcatggtggctcatgactataagcccagcactttgggaggccgaggtgggtgggtcacttcaggtcaggagtttgagaccatcctgtccaacatggtgaaaccttgtctctacaaaaaaatacaaaaattagccgggcatggggcacgtgcctgtaatcccagctactcaggaggctgaggcaggagaatcacttgaacccaggaggcggaggttgcagtaagctgagatcgcaccaccgcactccagcctgggtaacagagcaagactccatctcaaaaaaataataataataaaagtaaataaatcaataaattctggcttctaacttccatttctttcaaatcaatgtattaaaaatatatatctgaggtctgagggttcaacctgaacaagtttatttatttgtaaaagattatcctcaaatatatttctaaagttccagtcctcagaataacataataaagcgtatttccctgttagcatctattacatcctcattttcctttttagcacaagtctggacttatgtggaattctgggagacgttttgaagctattgatgaagtggtgaatccaacagaaatagatacacatgcaaagcagtgtgtattggacatgaatcaccataggggtgtctcatcctcatcgtatctatgaagaagagatgttaacacacaccagcctaacagcaatagcatagatgacacagggaagacatggaatgtttttctttcctctcgctttgttttattttttatttttgtcttatttatttatttatttattcaagataggatctcgctctgtcacccaggctggagtgcagtggctcaatcttggctcactgtagccttgacctcctgggctcatacagtcctctcatctcagcctcccaaatagctgggacctcaggcgcatgccaccatgcctggctaatttttttgtatttttttgtagagataggatctcactatattgcccaaacacatctcgaactcctggactcaagcgatctgcatgcctcggcctcccaaagggctgggattacaggtgtaagtcaccgtatctggcctatttttgtgtttaaccaatacttttattttttcttttaggttggacaaaacgtctaatgtataatattaatatattcacctttataccaatacagttgtgaaatataattttctttcttctttttttattaagtccaacttttattttagatttggggggcacatgtgtaggtttgttacatgggtatattgcatgatgctgagatttgtgatacaaataatcccatccaccaggtagtgagcatagcagccaatagtttttcaacctttgtcccgcttctccctcccaacccccacaagaagtccccagtgtctattgtttccattgtcaaggacatggaattttttgtgacgcaccacaaaatatcaatatatttaatttcatcacatgatctaagaataacttagtagcagaaaatgtatacttcatattacagatatttcacgcttaaaaaaatcacaacacaggtccacatcaatgaggagaagactaactctaaaactatgtgatggccggacacagtggctcacgcctgcaatcccagcactttgagaggccaagactggtgaatcacctgaggttaggcgttcgagaccagcctggccaacttgctgaaaccccatctctactaaaaatacaaaaaaattagccaggcttggtggcacacgcctgtaatcccaactacttgggaggctgaggcaggagaatcgctggaacccgggaagtggaggttgcagtgagccgagatggcgccactacaccccagcctgggcgacagagtgagactccatctcaaataaataaataaataaataaataataaataaaactatgtgatcagctgtgttcaagtatttaaattaatatttaattagcacgtctttgttaatctgggggattcatatatctgaagacctgagcccacggatgcatggtgagaatgtgttgcactcccttcactgtggcagagccaaggaagacagcagtgaaccgcagttattcccctcatgctgcaagatgtgtgctgaacaagtgattatagttatgaaaaatgttaagaaaagaaagtgcaggtggaggggccgtagaaatgaataatgggcaattagcctagcctgggcaatcaggagaaactccctaggaagttccacttaagttgagtcttggtgaatgagaaagggttaatcaggtgaagaaagctgtggggcaggagctgttaaatgtggagaagagaggtctaggcacctggctacataatgacccagatggaaactattccagaaactgaacctcagtaatgtgcctgaagcttgagaaagaagggaatagaaaactataagatgaggaaaagagattaagcataggtcagattatgctaaacctcataggacacattgcagatttcggtgtttatcttaaagaaaatagaaagccatagaaggctgtttttgttgttgttgttgttgtttgttgttttggtttttttttttttttagacagagtctcactctgtcacccaggctggagtccagtggctagagaattccactcccactttcctgatgatctagtgaggctgccagtgacttaacccaaccctccagcctttgaaaaatcaggtaacctagtccagagaaataagcatctttctcctaaaaatatacatcttaagaagaaccaagagtggttgaagatgagcccagtcatccatggagatgttgtacccagaaagctgtcaggacttcctgctgcgaagatgcccagagtcccccagttctgaaactgagttgtttaactcttccttgattctgtgaggtccccagtattattctaataaatgggcttttctcatttaagtttggcggggtgggtttctattgcttgtgtcccaagaactctgacactgccaggcagtgtgctaggtgatgtatatgataatttatttaatttaatttttcaaaggaaggtatcataatctccattttacacacaatgaaaatgaagctagttgaggttacagtaatttgctcacagacacacagtaagtggtgaagtgtgacaaggggcttgagtctttgcctggatgccaaaggctctgcatgttcttctatgtcacaaatgagcaaggatattaaaaagttttcattcattgccacataagcttaatatttcagacacattttgcattaaatgatcttaccaggtagatcatttgttatatctgctgatacaatagaaattttcttagaaaagcacaaaatgaaagcagagagagattattaacaagttaaagttctgtatattgttttaatatacatatgtgtgtttagttccctacctaaaatacatcacagtcacacaacattccgatcttttattctctacaatttttttttttttttagatggagtcttccactgtcgccaggctggagtgcagtggcgcaatctccgctcactgcaacttccgcctcccgggttcaagcaattctcctgtctcagcctcccaagtagctgggactacgggcatgtaccaccacacccagctaatttttgtatttttaaaagagacggggtttcgccatgttgctcaggatggtctcgagctcttgacctcgtgatccgtccacctcggcctcccaaagtgctgggattacaagcgtgagccaccgcgcccggcctttctactcttttgtgttccaaattcttttgtattccatcataataataacagtgtaattgcatgcagtcttacaatggtttttaagtctactcgtgacaagagcacagttatagccatgatattaaacaaaaggaaaacacgacaatcaataacgatgtacatataagtacatataaggaattgtactaaatgttgtgggataaacaaaataaaagaaataaacattttcttcaagacactgtctcattggaaaggcaaataacaaagatatgaaaaataaaataggtagaaatggaataaaaatgcaaaggtagcacgtgactccctgtgaaatgatgttttaagagagttaattacaaagtcctatgaacccaaaaggaaagtgctcagatccggaagaataggaaatgaagaacagtatgcttgtgtctgtccacaagaaaaatatatgatgtctaaataacaacctaaaataatgaaagatttctgtgatgcatggctgacacacagtacatcttcatctcaggggagaatttccagaagttgattttccagatttatagaacacaactcctgagtggtcactgcagcaactgtgtcatttttctactttttccagctgaaccagtgacaagttacatcactaatcctgagcttattaagaagtgtcaccatctcatgttggaaacctctccggagggtttggtactgttctctcaggtagattatttaagattaatgtcctgatatgacaaactgcatttttaatctgtcatcaaagcagattatcagaaccagaaatgacaagatttaacacacagtttttcatgcctaaaactaacagcaaaaactacaatgcatttcactacattcaaagtaaacatgatatattaatgaatggtttttcctctgtcaccgaataattatagattccttcttactaaaaacaaattatgtttatttcccttaagaagactatgattaattatacacaattacacttgcctttaattgaacagatttcttctttactctggattagtgggttattgtatattattaaatagcttcagaaaacccaaagaaggaaacctttctcttcagaactaaagctgggtaagtaatggtggtcgtggaactatggataggggtcaaaaaagtttcattttcttgttaaaatgacctatggcaaacagagctaacagtgtcttacagttctgatttattggaagcacattgatatgcctgaatctcagaaattgtattggaaaagccacaaatgaaagctgagagagattaacatgtggtgggctaagactttgtaaagatagattcctaaggcaggatttctcaaactcaacaatattgacattttaggatgtataatttttgttgttgttgggggttgtcttgtgcaccacagaatatttgcagcatctatccactagatgccagtaacgtacatcctcacagttgtgacaaacaatgatatctccagacattgccaaatgtctcctagaaggggatgggggcggagtggggtagaggggagcaaaattgccctggttgagaaccaccacccaaaattgtagcattcctgtctggccccaaatctagaggacattgtacctgattctgctagatgctgaaagtgtataattctgttgtgataacagaatatccagaataaagaccatacttcccagcctcacctcccttacagctaagtagggccatgcttctaaagtcaggttaacaggatttaagcaaaaattgtgtgggaacttcctggtcatgcccataaaaggaaaaaaatatttccttctattctactttccaccttcttgctggctagttatagacatgatggtgagagccagagcagccatactggacacagggattggagctgtgtgttgagtatggcagagtaacaacagcatgggtggctggatgtttgacatggtagaggtcccatatcagctttgagacctgagagagaataaacttctctcttgcttaaatctctgttctatcaggttctttgttatagcaactggcattttcgtggtaactaacacacatcccaactgctgttgcatgcgctaagccaaaaaggcagcaatgaaaagaggagggatcacttcttgtccttttgggtaagaccaagtataaaacagggagcttcctttgtcccactggaatctaaagaagctctaactgggtctacatccttgattggaaaacagtcatttttaattgtaacataaacaaacaccagggaaagaaacagtgagcagtgagggaggacggagttagtgattcagtcagaccaactgaattcacacaggcgatccaataggaagacagtgtgcacagttggtcttttcttagcttacactgagattcacgtctggacaggtgaggctggcgaagtcccctacacagctgtttatttgcatgagctggtttgccacgcaaagagcatgctaggccaggcacggtggctcatgcctataatcccagcactttgggaggctgaggcgggcagattgcttgagcccaggagttcaagaccagccaggccaacatagggagatcccgtctctaccaaaattagctgggtgtggtggcgcctgtagtactaactacccaagagtctgaggtgggaggattgcttgagcccaggagatcaaggctgtggtgagccaagattgcatcactgcactccagcctgggtgacagagcaagactatctcaaaaaaagaaagaaagaaaaataaaaagaaacgaaggaaggagagagagagagagagaaagaaagaaagaaagagagaaagaaggaaggaaggagagagagagagaaaggaagaagaaagaaagagagagaaggaaggaaggagagagaaagaaagaaagaaaggagaaagaaagaaaaaaaagaaaagaagaaatggcatgttaggttgtacttttgtgggaatgtaagaatgagaaagacattatcagtggaacggatggccttgtgtctggtcacctgtccagccccatggacaatgtatgaaccaatgaagagtgaacgttcataagctcaagtgaggaaatgggttcagaaaggtagtcatgaaacgcatggcacagagcatgacaaagagtgcccaaagcaggggggagagctctctccccactttggcaaggaatgcagccccaactgcgtgaactttctagttcctccatggtgacaaccagaggaccagggcggaagcttaggggaggggagggccctgcagataacattgtacctcacaaggacctgcagagaacaatggtgttgagcagtgggaccggactttgcttataagcacaagtgagataccccatagaaatacccagaaatgctttacgatggaggacattacaataagatgaggccatgcatcactgggggaagccttaagctggcaaaggttgaccattaatgttgacggtcccctgtggcagataatagtgaattcctgacccagtcagcattccaaggcccttctccctaccatgttgttccagccatgaggggatctgaggcagtgttctgggcaacatgaccaaaacagaacactagtggtgttcctgaaaaaaaaaaaaaaacaatttttttttctgtgatagaaacactgccttttctccttctgtcttcttcctggaggaatgtgaacatgattcctgaagcaacagcagcagcagccatcatctttaagcctccgcagtcgctgatttctgcatctcttgttctgtgaggaaaatagccccatgtgcttaaatggctgtagttgagttttctaacacttgaagccactgctgattcatggctacaggctgataaaagcaggggaaatttatattacagcaaatgttgctgccatctctcctgaaaaagtggtctgaggatcatatacaagccaaatatctcctttcacatactttgcccagtctatatgtggcctttgtcatctcacaatgttttcatgttcacttactcatctaaaaagtttgttactggcgaggatgtgggaaaactggacccctcctatactgctggtggaagtttaaaatgtacatctactctggaaaatttcttgacagtttttcataaaactaaatctgcatttgccacataacctagcaatcatatcctcttgggcatttatcccagagaaatgaaaacttatgctcatatacacagagaataagtctgtatatgaatgctgatagtagctttatttgtaatagcaaaaaaactgtgaacaatccaaatgtctttcaaagggcaaatggttaagcaaactctggcatatccatacggtggaatactattcagccacgcaaaggaataaactatggatacatgcgacaaactgggtgggtcttaaggacattatgctgggtgaaaaagtcaatgtcaaaaggttacatactgtatgactccatttatagaacatcctggaaatgacaaaagtgtagagatggagaacagattagtggtggccagggattatgaacagcggacagagggaggatgcaaaggggtagaatgagggagttcctttgtgctgatggaacaattctgtatcctaattgttgtgttagctacaacagtaattatgtactgatctataactggggtcaaattgcatagaactataaatacacacacacatgagtgcatgtaaaaactggagaatgcagagtaaggtctatactctagttactagtgttattccacgccagtttactggttttaatatggtactatggttatataagatgtcaccacatggaactctatgtgttaagtgttgcagctttctgtgagcccatacatatttcaaaataaagaggtttttttttatcagccttaataatcagaaaaaaaggaataactgatgactcagagtatcttttccgaataaaatctacaatcattttccttcaaatttctcatatgattttaagcttgatagatatttcgtctcattaaaatttacgtgacatggccgggcgtggtggctcatgcctgtaatcccagcactttgggaggtggaggggggcggatcatgaggtcaggagttcaagagcagcctggctaacatagtaaaaccctgtctctactaaaaatacaaaaattagctgggtgtagtggcacacacctgaagccccagctactcaggaggctgaggcaggaaagtcgcttgaacccaggaggcggagcttttagtgagctgagactgtgtgactgcactccggcttgggtgacagagcgagactccgtctcaaaaaaaaaaaattaacgtgacgtaaccatagaaagaaagaaaaaaaaagtttggctttagggagaagaaagcagagaacaatatgtatcctttggtcttagaaacgaatggtaatgaaacaacaaaaatagtttcacaaatttttacttagaaaattgaacttaagagccttgttttgttttgtttttttggtgaggcggcgcggggagttttgttttttagctgggcatggtggcatgagcctgtggtcccagcaactagggaggctgaggtgggaggattgcttgagaccaggagatggaggctgcagatggaggctgcagtgagccgtgattgtgccactgtattacagcctgggtgacagagcaagactctgtctcaaagaaaaaaaaaagagtcttgttcaagcataagcaatgggtcaaaaaataaggtaactataaatacagtgcagatgtgaatttttaagtcagtaacattgtttggggacttgatccagttaccttttatggtccaaagaaagactctctgtcacccaccacacgattagtcatttttttctacctctcttgagaaaaaatgatgaaattaataaattgtgactattaagcaagttataccaacgccatatgcaattttcccagaaagacaaattgtaaaggaaatgcttgcaaagttcttacacaaactctcttggaagagaataaaagagcagctgtgcactgagcccccctggttgtctgaaatgaggtggtgagccaccattgagtgtatcagttacctttgaaagttattaccgtcctcattttcatctagagggtaataaaaggtgtcagaaagtttttgctttttgaagcagtcatctgcttatttctagaagtaactgtagattagcgactaaatccccaaattaaataaaaagaggagtccaaattgctagaacttttgaaagaattactgcagcataagcaggtgtgggcgttatataaatgtgtagcattatcttgggtagaattcagagggcccagcagaaaaactggttttggtcatcttgtgtcctgaagcttcagacccattacttatcaaaaaaaaaaaaaaaaaaaaaaagtaaactacaaagggaagggagatatcctgattttgacaaagcccgagtatgttcatgaacaactctcacgttttaaaattttacctgtgacctctggtaatttgcaaacatgaagagacatggaagacattctggaagcactaactggattatgcaaattgaaaaactgcagatatcttcactccgaacatgacctaccaatgtcagacccacattaaaatcatgacaaatagtggccactaaatgaattcctgagtaaatgagattacaccaaaacttctagtttatactctcagtttaaaatatatttgggggttattatatgattaaattcaaatttcaatggtaattttcagaatatgtgaaatgccagaagatacatcacaattattcggagttatttataaggattaaacctctggggggaaaggagagagccatttagggggtttgtttatttagcatcccatctgcagtagaactgaatattttaaaaaagcaaaaagctgaatgatgacatcaatctaaggatccaaggtatccaactgttaggaaagactggatcggagaagattgtaattgtgaccataattcgtattgtacacattggtcaatttctttaacagcggctgcagaaaatgtcaaagctcaattttttttctcctccaactctttgatattttgctgtgtgactcacgtcctgtagtaactcctggctgacttgaaagcctttctaggacatcaattctcaggactcaattttctctatcagattgttgcaaataaatctcattttatatctcagctcataagagcagtgaaaatgctttactgtgtctctgctttctattgctgtgtttaacgctacagctgaggacttgattgtccctccaagagacacgtaagatgggaatgtgaattcccttcccccatcccttggctcccagtgacaatggagcatgaagatagtaaatcatcgtcataattgcctagacctatctagtcaactggcttaataagacgggaagtaggttgctgagaaagaggaatgacgttttaacaagacgactcaaatcaaactataatttatccttcacaacacctttaatttttccggaaagttatcagaagcaaaatcgccattttgaagataccaaacacggcttaacccttttcaatcacttcattaagtcaacagaagcatacaaagcattcttaaaatatttgcaaatatatgctagcaaaattccatctaactacctcattatctggtagtttcgtagcatttgagttttaaaatattgtctttgaaaagacagaagttcaaaactgcgtttttctgcaagacaattccatacttgcatttccaccttctgctaagaaattgggtggacctgagctttgtgctcactgcctccaaaccttgttaaatatttaaaaacccctggcagcccagcagccccaagtccgcttggggctgtgttccgattcagaaacaaagtgaaaggtttatcaggggatcacccttgcaacagtttccgcaggcacctctgggggctgggacaccgcacgcaccctggaggggcatcctggaggccaccacacgcaccctggaggggcatcctggaggccaccgcacgcaccctggaggggcatcctggaggccaccgcacgcaccctggaggggcatcctggaaagcacctaggaatgtgcgagcttggccgcggctgtgcttgttccatccttgacgcatggcagctttgtattgtccagtttctgacctccatttagattaggactcagtagaaaaaaattgaaatcgcaaatacttctcttagttctcccttgattttttggttgaaaggctttgcctgtgctggccaggcgcggtggctcatgcctgtaatcccagcacttgaggaagctgaggcaggcagatcacgaggtcaggagttcgagaccagcctggcctatatggtgaaaccccatctctactaaaaatactaaaaatacaaaaaattagccaggtgtggtggcgcacacctgtagtcccagctactctggagactgaggcagaagaatcgcttgaacccgggaggcagaggttgcagtgagctgagatcgcaccactgcactccagcctgggtgacagagcgagactccatctagaaaaaaaaaaaaaaagaaggctatgcctgtgctttgtttttacttgaacactttagatctgagaactgaaatcacagcagggctggggctcacctgtttccttgtacttcctcaccttctcttttcttcctttccttcatcctaacttattttttaacccttttttcttttcctcttccttccttattccctctctctcctctttcctttcttcctttttcttaccctcttcctttgttcctccctttcttctccctttcctccttcccttctttccttcttccttcctcccttcctttctccttccttcctccttctctcccttcttccttttcttcttttctccattccttcccctcttccttcttccttttccttccttcttccctctgttccttcttctttgggtatctcaccttcacagagaccctccctcttgctgtctgaaatgcctgctggcccttgagtcaaatgtaagtcttaaaacttacatttttcagttacttccctgaatcttgtacttgtacttccctgatcaggtacttcccttgaatcttgtcagtcaggattttgttgctctttaaagcctgcatttctgccacgctgttgaggagatttaaagtgtgctctgtgctggcgtgaaaatatgcatcctccctgcagccttagctttaagcaagaggcaagcactgatggggggtagccctcacctggtgtcctgaaagggagtagtctaggaatgtgtgttctacactggcaataggtttatttgcccatgattttgactttaaaaagaaaacttcaaacacagaagtaagtatactaaacagtgactgtattaggcttgtccttactgatttcctcttcacaactatgcccaatttacacctgtggaaacagaggcacagataggctaaacacacccccagtgatgcacagctggtctgtgtcagggccaggatttgaaagccaggcggcctggttctggagctctgcctagaaccactattctgcaatgcctctgtcagtagacggaaacataggacatagtttagagggttttcatacatatatagggtgacactgttcatactattctgacatttaaaatcttttctcagccaggtatggtggctcacacctgtagtcctagcactttgggaaactcctggcttgaggccaggagttcaagaccagcttggacaacatagtaagaccctatctgtacaaaaaattgataaattagctgggcatggtgatacacacctgtaataccagctactctgggaggctgaagtgggaggatcgcttcagcctgaacgattgaggctgcagtaagccatcattgcaccactgcactccagcctgggcaacaaagcaagaccctgtctcaaaaattcaagaaatcatttctcaagggtgatgaggagtgactgcttaatgtgtatgaggctcccttttggagtgataacaccgtcctggaattaaagagaggtgatggttgtattgtagaaccttactccttagttcagctaaatctcaggttcttgtcacacgaccaggaaaatttaggcacacggacacattgaagggtgagtagagcaggactttattgggcaaaaaggaaaaaaagaaaaaaaaaacactcagcaaagtgagatggagacctgtaacatgccgtccacctcacagactgaatccctggccaccacacaggaacctgggagagcaggctcctcccctgtgtagggtgccaattccccatggctccacccacttcccccagtgcgcatgtggagctccagtccactgtgggcatgcccagacaaagctttgggcagagtccctcatctgcacgaaagcatccgatgtaaacacttgtggggcaggttggagattctctggggaccccttcttatctgcctaagcatttggctgtctcagttgcacactatgaatgtattaaatgccactaaattgtacacttaaaaatggtttgtggttaattttatgttatgtgaattttgccccaattaaaaaaaaattagtatactgaagattacataatcgtataataatcagtttgactatttccctatttatggacaatcaggttatttccaaggttttgctcttacaatttatgcttcaaaacaacttccttgcacttatgtgtttgtacacatatttgagcatttctataaggcagtttccttgaagtatacacatatttgagtgtttctataaggcagttattgagttggaggttgttcctagtttaagttttgatagatactaccacagttccctcaaaataaagaagtgccaatgtgtgcacttaagtaagaatcaccactcaagattttttttttttttttgagacagagttttgctcttgttgcccaggctggaatgcagtggctcactgcagcctctgcctcccaggttcaagtgattctcctgcctcagcctccgaagtagctgggattacaggcacccgccaccaagccccactaattttggtatttttagtagtagaaacggggtttaccatgttggccaggctggtctcgcactcctgacctcaggtgatcctcccaccttggcctcccagagtgctggtgtgtccggaattggtgggttcttggtctcactgacttcaagaatgaagccgcggaccctcgtggtgagtgttacagctcttaaggtggcgcgtctggagtctgtcccttctgatgttcagatgtgttcagagtttcttccttctggtgggttcgtggtctcgctggctcaggagtgaagctgcagaccttcacggtgagtgttacagctcttaaggcagcacgtctggggttgttcattcatcccggtgggctcatggtctccctgggctcaggagtgaagctgcagatcttcgcggtgagtgttacagctcataaaagcagcgtggacccaaagagtgagcagtagcaagattcattgcagagtgaaaaaacaatgcttccacagtgtggaaggggatccaagcgggttaccaatgctggctcgggcagcctgcttttagtctcttatctggccccacccacatcctgctgattggtagagccgagtggcctgttttgacagggtgctgattggtgcatttacaatccctgggctagatacaaaggttctccacgtccccatcagattagttagatacagagtatggacacaaaggttctccaaggccccagcagagcagctagatacagagtgtcgattggtgcattcacaaaccttgagctaaacacagggtgctgattggtgtgtttacaaaccttgagctagatacagagtgctgattggtgtatttacaatccctgagctagacataaaggttctccaaggccccaccagagcagctagatacagagtgtcgattggtgcactcacaaaccctgagctagacacagggtgctgattggtgtgtttacaatccctgagctagacataaaggttctccaaggccccaccagagcagctagataacagagtgtccattggtgcactcacaaaccttgagctaaacacagggtgctgattggtgtatttacaatccctgagctagacataaagactgtccacatccccaccagactcaggagcccagctggcttcacctagtggatcccacatccgggctgcaggtggagctgcctgccagtcctgcgcgtgcgctcgcattcctcagcccttgggtggtcgatgggactgggcgccatggagcagggggtggtgctcgtcagggaggctcgggccgcacaggagcccatggagtgggtgggaggctcaggcatggtgggctgcaggtcccgagccctgccccgcgggaaggcagctaaggctgggtgagaaatcgagcacagcgccggtcggctggcactgctgggggacccagtacaccctccgcagccgctggcccgggtgctaagcccctcactgcccggggccggcagggccagctggccgctcagagtgcagggccagccaagcccacgcccacccggaactccagctggcccgcaagcgctgcgcacagccctggttcccgctcgtgcctctccctccacacctccctgcaagctgagggagccggctctggccttggccagcccagaaaggggctcccacagtgcagcggcaggccgaagggctcctcaagtgcggccaaagtgggaacccaggcagaggaggcgccgagagcaagcgagggttttgaggactgccagcacgctgtcacctctcactgggattacaggcgtgagccgccacgcccagcctggagacagatttttatattgcaaagtggttctcctgctgcgtgttgatctctgcaaccacatattaaaatacagcacactcaaagcctcattttgttttactctgaaactcagatattgggtggggcccactatggttcctgtgtccctagcacagacatagtggttttagaggtcctctgctccagaccctacttccacacattgtatctctgttctactctaggggcccaacttcactggtttaaaaaaaaaaaatctatttccaccaaacatgttgtcagtttgattattatgaagatttgaagagccagagagaggagtcacatcccgcgtagacccagtcatttcatacccaggtccctctggaagcctttttctatctctttcttccccttcttcccaggttccatcctctacaggcagccttacctcaccctggcctctgagagctgggccttggcctagccaaaccctggaggctcagcccctacccagggagacttggagaggcaatttccccaaagatggctctctccttaggaggaattttcacagcagcagctaaaaatacacaatattccaaacctcatttcagaatgtgttgtatccttcaccctgaagcaagaatgtgctgcctcccctttgtgggaaaagcactcaccctcccttgcggacttacctttcccatacctgcctcctacacgagatatctctttctctggatcctgacactcaagatccttaattaactctgtcagattgtccttcatctgtttaataacacccatcctggcataaatacctctactctttctcagcaggtaaaatgagaaaatcactctcctttgcacaaaggcatctgtgcactccctgctttctgtccatgcctaataactctacctgaatcaccacagagatcacgtttcacttttctcaggtatctgaaagacggaggcctagtcacctcccccagtgttcatgctgtcctaagaatgaggttagtacagggacagaaacaaatattgtctcctctccgttacccactgtaggaaatacggcctcttagttgttgtcttttctcagtaggagaagggatttcttttttctatcacagaaaacaccccagaagtacatctgtggcggaatcttgcaaaagtaatgccctccgagaatccaattattcaggttctctatgactcaaaatctttaactctcaggggtttgggtttaccctgcaggggcaggcagccaaaaaatgagcagctagaaggagtgaagaatttcctaagggacagcagacacctgttacattcgaatccccagaagccaaaggctatcctctaattttctgagagctaattgttccaagacccaaagggactctctacataatcaatttctgcagagacttcattccctggtaagaatagccttttcctttaattttttttttttttctgatgagcttaacccatttaattccatctaattctttaatgaagttctgttttccatacggattctcacatttttaagtatattgtccacttctttcctataagtattggtgagaatgtctggcttgcacaacttgagctgtgcctacccaatgtcaagaacaaagcaaacgaaaaacaaaagatccaaaacaagaccggttcattgatttgatcatcagttggacaattagttaagctgattgctttactgaattagccagtgatttggtcaatgtgattagttgattcacttaacactgtcaaaccatctagatagccaaattccagaaaccttttaaaataacttgtgttctcttcctttaaaagtaagcaaaaataaggctcctctgaatttttttgggggggtgggggattctgtcaactcctgaggaaagtcatgtggctaagaattgtacaaagaagcagtgcaaaggcacttgccatccacaaacaacaaacccttctaagaagtactgatactacagtaaagaatccctggaaatataaatattcaggctcctgaggaatttttagttaatcttattggacattttgcagtcgcagactcctatctatgaatttcaaatggattcacttttttcttttttaaaaaatggcaaagggtaacaagttgatttttcaatacagtctcacagggtcttcttggtggtctgcagtttgacccctgatgaaatattaattataaactgccatcctgggcagcagtaggtctcagatgggggtcctgtattcactagtaagtggatattttttcaaattctaaaagattttattccaagggtaccctggtctgacagaactataaagtacataatttttcatcaacctcgctaatccagccccagtcgctggctatatcccaggccctctggctaataggctgcagccttcggggaggggcaggtactcctgggtttggtggctgcaatgaagtgccctcacttcttcctatctttctatccttactatttcctgaccccaataccaaggcatactcaaacatgtgtatgtatgtgtgtgcgcacacatgcacacacaggcacacgtgcacacacctcattttaaaattattttaagaagttggcagcttataaaagtaaaagctcaccttctctatagccttttgttaatttctcccctttttggtgagttttcaaatacaatgatcagaacagctgagtaggggagagacataaaaacatgttggatatgatgatatatgagtctttaaatagcctgctaaacacagaaaacactcatttgtctacacctcagtttcccctttcaaaaaatgagggcaactgtgtctgcctgtgatttgagaaggatgaacaggatcatgttttcaaagtctctttaagcttctctgtacagcggtgccagcaaagagcaaagtattgttttccttcgggcagaataattaaaacaaaatctcctgagtcccatcttcatgcatgtctctcaaattgatcatgtggtgatttttaagaacagagcagctctgtgtcatttatttataatagtttttcattgttacagtggggcattcatagccataccttcaggctctgggggactgttcacattcattagggaaaggaaatagtctttctttcaaataggcaatttgattgcttcaggaatgggtctgtaatcactggagcgctgggatatgttgttgttaataagataaagaaaccaggctttctgcaaatcagaaggggtttggcctcttcttccagagactgtaattaaaacgggtggcagtgattccctgtgacctgtgacaggactggcctcaggctgcaaacaccaggtcggaggtgaatctttcagtcttgtcctttatggagttcggcagcccaagtacagcagccattaaggtctcaagagtggtcacgtagaaagagttcatagtgaactccctattcacatatgcagtggggaggttggggtcctcgggttgtggcttatatctatattctttaaaaaaaattttttttgagatggagtttcgctctgtcacccaggctggagtgcaatggcatgatcaaagctcactgcaacctctgcctcccaggttcaagagattctcctgccttggcctcctgagtagctgagattacaggtgcccaccaccacacccagctaatttttgtatttttagtagagacggggtttcgtctctactaaaaccagcctcaaacttctgacctcaggtgatccacctgcctcggcctcccaaagtgctgagattacaggtgtgagccactacggccggcctacattcaaaatagtataagagcagcggccaggcgcagtggctcacacctgtaatcccagcactttgggaggcggaggcgggcggatcacttgagcacgcctgtaatcccagctacttgggaggctgaggcaggagaatcggttgaacccgggaggtggaggttgcagtgagccgagatctcgccattgcactccagcctgggcgacagagcgaaatgccatctcaaaaaaaaaaaaaaaaaaaaagcagtaactaggggagcctgatgagcttttagaatcttactttttatatccagaggctatatcagattcaattgcgtggacaaattcaagagtatttaatactttaaatttgacagcaaccaatttgtgtcctattagcaatgggtaatatagttttctggctttcattttatcaatactttcaatcatgtgttcatacaatcggtttactctgtaaacatttatttcctgttctattccaggcaaagtgcttggctctggggcaaagggcccttgccctcaaggaatttgcctactgatctgccccacacccactgcctctggttgtgctatttgggttgttagcctttttaatttttttcttgtttaaaaaatatagcttatttatttatttttggagacagagtttagctctgttgcccaggctggagtgcagtggtgcgatcatagctcactgcaaacttgaactcctgggctcgagagatcctcctgccttagggtcccaaccagctaggacaaaagttgcatgtgaccacacccagctaattttttatttttgtagagatggggtctcgctatgttgccccggatggactccaacttctgacttcaagtgatcctcctgcctcagcctcccaaagtgctgggattataggtgtgagtcactgtgcccagcctagacttttactttccttatgtcttgtgtttcttgttatatttaaagtattttaccattttggggggatactctttgctcgcccttatgaagttaccatctaaacacaagaaggcacattacactaaaataagaagccttaattcccctactttttgctaaccatttgaaactggaaacatcacctttttcatcaaataaaatgcagtttggtggcattgtacatagaaccaagaccgggaaagcaagtctatttggttatacttgatagagttcgttttggtaaaggacggtgcaaacaatttctgaggacattgcagccatggatatctgagggcaacttttcatttagtgcagatctgctggcgtataaggatttgaaattgtttttcaaagagcagattcttctgtcagtaccttagggaaactcttttctaatagaaaaaagtcaattctggaatagaaagaggatttttccttgctctgcaggacgggatgcaactggcatttgtgtttacagatgatagtattggtatcattctagaagagactgctcttaaattgtttccacttcagtgacaatggattcatacttatctatgtattccttcctgacccttatgaccaatggaattccctggggagagtgtggacaagatctaaagtcatattagttaagactcttgggcggcaagtgacagaaaccaaaaggactccacttaggcacaaagggggaatttggtatacatatacaaaagtgtgttgaggaaccaaacgcaggagtacagccagaccttaggaagggcaaagttgagaacgaaaaagcatccgcattcccaagatgcacccttggttcatctttcctccactttttttgcacatctagctcattctctgacactagagtcctgctttctctgcttctttatccacaaggctgaatatggctgaaccacagcaacaagtttagaggtgattgttctctcattcacagagaccgtgtgcctgtctctccatttcttccttctgggagaaggaatctgattggccctgcttgaaacaagtgttcagctctgtccaatcacctgaggccagctaggtgagtcactcacatgggcagagtccctggaagcccacttctgtggatggggtgcgtctcagaaaggtagaatggtttgagagctggtatgttgagttttggtaaagataccccaagaagtgtctccagggtggccaccaaattcttgaaacacagggaaaagcataatgaatgggttataaatcgtacataataaaaatagtattatctatgtttccagacttgctggccacctcatactacaaggaatagagtttacagccctaaaacagaaggattctacagggaatgaatttgtgatgttgtcattagcctggatgtccatttatctgagctaatcggtcataaatgcccatgtggctcatgtaaataagattcgtacataataaagagataattacctcagctttctagttgcaaccaaatatcctctagttacagaggatacttagcaggctaattagtagcattcattaccctgcccctagttccccaagaatgattcatgtgagatcctaagtaactcaaaccctagtgctctgatttggaacaaaaggaactgagagctagagggatggccccagaaggaggctctacagcttgttgccatacagccagagaggggcattaattaacaacacctgcttgaaataatgcacaggacatgcctggcttcagctttaaactcttagtgtctgcatccttgtgctccttctatttatcctccaaataccatacacgtaggctcaggggacaaccggatggtacactcaaatgatgacaaaaccattgagattcacataaattaataatttgcctttccagtcgacgtggaaatccgtcagcactctattggcaatttctatcagctctctttcaagctctgtctcaatttatcccagatctcagagctcctcaccacctccattgccaatgtgtaatcaagccgtaatcatctcttcttgattactgccacagccttctaatgggtctccttgcttcaactcttgcccctctgcactccattctccatagtgtgatcttttaaaagtgcaaagcatatcctgtcagtacctttaacattgcacttacagaaataacttccagattctttactatggcctacaaggacctaagggatatgggtcctgtctgctccccttctctcacttagtaccatctcccccaccccaccctctgtccccacttttttttaatttctgttctggactctaccaaccttattctggctacaggctctttgcactggctattcccttagtctgaagcacttctaccccagaacttcccatggctggctcccttcatcatccaggtctcatctctgatgtttcttctttagagatgccttccctgacattttaactaaagcaaaactatctattccccatctcccccacatatcccacactaatttcttcacattatgatctgaaattattatattaacatacttgtctgcatttttatcatgttttcccccccagaaggtaagcttcattaggacaaggatctcaggtgattaatcttgttcactattgtgtccttagcacctagcacatagcaagtgcgcaatgaatggatattaactctactaatgaaagagtagaggaggccaggcatggtggctcatgcctgtaatcccagcactttgggaggctgaggcgggcggatcacctgaggttgggagttcgagaccagcctgaccaacatggagaaaccccatctctactaaaaatacaaaattagccaggcgtggtggtgcatgcctgtaatcccagctactcaggaggctgaggcaagaaaatcacttgaacccgggaggcagaggttgaagtgagccgagatggtgccattgcactccagcctgggcaacaagagtgaaactccatctcaaaaaaaaagagtaaaggaaaaacaatctagccaagatttttaattatagaaatctgttaatataaaatttataatatcaactttatattttctataaaatgctacacagaggccaagagtggtggttcatgcctataatcccaatacttggggatgttgagctggaggactgcttgagcccaggagctcaagatcagcctgggcaacatagcaaggctccatctctacagaaaaaaaaaaaaattataaattagctgggcatagtggggcctgcctttagtcccagctactcaggatgctgaggtaggaggatcatttcagcccaggagtttgagactgtgctgagccatgattgtgtcactgtactccatcctgggtgacagagcaagaccctgtctcaaaaaaaaaaaaaaaaaaaaagctacccattaggtccaagttgtactcaaagtgattaggttatgaaattgaggcttgccatgaaggtggttatattaaacaagtaacttgtattaccttgataagattattacactttcttctgcttattaatgttgaaacatttataagttaggaatgctttggttataaatagcaacatatctgactataatttacatctgtagagctgttctggctccttatactatgtaacaaaacactcacaaatttgtggcttaaaacaatattcattttgcttccaaatctgcaatttgggcagggctcagcaggggaagctcatctgcgctccacttggcttcagctgggagtgggccgcaatcacctgaaggctattcacctgcttacttggtgcctgagtagattcaaatgtctaggggctggaacagctggggccccttgggcatgtatccctttgtgcttcctccatgtgatcactccagcatgttgctctcttccatttgttagaagcaacaagctcaagctgatccataatcaagggaaaaagaattagacttttccttttgatgggaagagagtcatcaaataacttgtgaatctgtttttcttgcataagaaaaagtacaaagagcaatatcccaaggctattgcaatggctcaacaatgttattaagaaaccagacagtactgggcatggtggctcacgcttgtaattccaacaatttgggaggccaaggtaggaggattacttgaggtgaggagttcgagaccagcctgggcaacatagggagacctccgtctctactaaactttgtttttttaattagctgggtgtggtagtgcatgtctgtattcccagctacttgggaggctgaggtgggaggatcacttgagccaaggaggttgaggctgcagtgagctatgatcacatccctacattttagcctgggtgacagagcaagaccctgtctctaaaaaaaccaaaccaaacaaaaaacagcccagtctcatgcagtggctcacacttgtaatcctagcagttttgagaggctgaagcctgaggccaggagtttgagaccagcttgggcaacacagtgagaccactgcctcaaaaaaaacaaaacaaacaaacaaaaaaaccaaaaaaaccccaagctcttttgaccatttttctcagcatctttagggtcttggcttatcatgttatgttgatataatggaatggcttctgcatctccagtcatcacacctgtattttaggcagaacaaaggcagaatgtcatttattctccaccgtgccccggtataaccatgcggctgaattcctcttagattaaattgcatcgcatggcgctgtcaggagctcagtagagctggaagggagctgagctgtcaggtgttagagtagccacttgaagctacaacaagcacaaatggaagtaatagcgaagactttaatcccgcactgcagtagtacaagcaagaggctaacactggagggagtgctgagctctcctgcttcattttccccttggaacaatgcacccatacggttcagggtcaggaggatcagcacagatgtgggggtcatctcactcttgagggggcccctaaccaaaggcttcctgaagggttgtggaccaggggctggggagttgggtagtgagaggggaaaaagctgagagtgtaaaagtactgagtcagagtgaagaaaggtgtcttcccttaagggtccctgagccctccgaacagagcacctggactaggaaagcagatccacaaaagggcaggagcagccagaggaggctgacctcttgccagagactctctgaggtggcaccggctgtgcagccttccggtgaggcctgacgggtgatgcctctggaatagcagtcggtcaggcctgaaaaaaatcacacatgggtttggttttgttgttgttgttgttttgtttttgtttttgtttgttggagacggagtctcgttctgtcacccaggctggagtgcagtggcgcgatcttggcttactgaaagctccgcctcccgggttcaagcgatccttctgcctcaacctcccgagtagctgggattacaggcgcccgtaccacgcccaagctgatttttgtatttttagtagagacagggtttcaccatattggccaggctggtctcaaactcctgacctcaggtgatcctcccgcctcggcctcctaaagtgctgggattacggtcgtgagccaccgtgcccagccacacatgggatttaagcaggaaccagactcctcgggttccacctagccatgggcaattggggaagttgaaaatttctctctttagcctccacaacagagaaagacaagggcacaggtgactggcaatgaatggcgagtgaacagatggacgttatctgccaggcagcataaattcccagaaagaatgctcaatgtttgatgattcaactatacattttaaaacatgttgtatgttatatatgtagcagacatcaaataagagaaaatgtgagtttgagcagagaaatgtcagggaaaaaaattggggagggaggaaatgagaggaaagggtagggacaaagacggatcctctgaagtccacaaggacaagaggtgagtccaacacctgggactttagtttctcaaacccaagttaggttggttttggtttcatgtgacttgcatggtggggacaggccctcctgtgtcctgtcccttctgcatctcgcacccactgtgccttgcctcacagcatcacaaaatttgtgtagcttctttctggcagtagcaggataactcctttgtcagcattaaagatttataatccaggcccggcgcagtggctcacgcctgtaatctcagcactttgggataccgaggcggatggatcacctgaagtcaggagttcgagaccagcctggccaacatggcagaaccccatctctactaaaaatactaaaactagctgggcatggtggcatgtgcctgtaatcccagctactcaggaggctgaggtgggagaatcacttgaacttgggaggcagaggttgtagtgagctgagatagcaccattgcactccagcctgggtgacagagtaaggccctgtctcaaaaaaaaaaaaaaaaaaaaaaaaaaaaaaagatttgtaatcccaaatgagtcctgcagttttccaggctcctcttcaagcagaaagttctgcaaatgaacgcccctagccctgcatgtttatttaccatcttctctgttaggcttcaacagctgtaggaccgtgctcatataaaaaagaaaagaaaagaagggaaaaaagtcttcctgctaaattcatttctttaacatttaatttttttttcctgccaaagtcagagatgaattagcaattacttgggagccaattaaaattcatagtaagctattctctgacccttgggtcaggaacaaatttcctataaaccttaggagggtatctctcctgggttttttgagggtgagaaaaattcatatcctgcgctccagttctcattcctcatacagagtggtggccagcgtgttcctgagacattgtttgtgcaacccagagacaactcttaattccccgctcagttatttctctgtgatttggagagaagatgtggctacagctgccagtgactctcagctgcgattctatggaagttgtggcaagaagacacaactgaagaagggaaagattctctgttttccacagttctgagatttgtgccttgcctcacagcatcgcaaaatttgtgtagcttctttctggcagcagcaggataactcctttgtcagcattaaagatttataatctgtagagctgagaagagagctgagaagagacctgagtagaaagctagcattaccaggtgtttagcaggtgtcaaaaacatgttaaagttgaagagcgtcttcttttccatgaggcaatgatacaattgcatggtgtaggatctgtgagtgactctatacaaatagaaaagtctatgtcacaatgtttagaacttcccaccccagtaggattagaaaactctcagattcctggtagttgacaaatcctttttgttggtgagaaaaaacaacctttgacttggagtcattaaaaggattggatacctaaaaggattggatacgtgcgaagaaagacagtctctttctgcctctatatttatataagagcaaacgctttccagcatggcacatctgaagataatatgccatctctgatactgtgctgtcaaagggacaggaaaaaaaaaagatttatataaaaagaaatgcaaatataactagctagttagccaagagggcaaaaggagggaaggcttacattaacctgatcttcacagtctctaaaaacctgacaagagaaatatgaattttaactagctgccaagcaattggttattcatgcatgacatgaaaagcaggggaaactttaattttctccttgtcagttttaaacagagaggctgtcaattcagcaagtgcagctactaaacatattacagaagggcaccatcctaccaacatccagtctcaagatgacatcaggcccaggactgcagcaccattatgctttcatcacattgcaaacagccctgcccctgttatgcactgtttctttctttctttctttcttttttttttgagacggagtctcgctctgtcaccaggctggagtgcagtggcgtgatctcagctcactgcagcctccgcctcccggattcaagcgagtctccagcctcccgaatagctgggattacaggcactcgccatcatgcccggctaatttttgtattttagtagagatggggtttcaccacattggccaggctggtcttgaactcctgacctcaggtgatccgcccgcctcgggctcccaaagagctgggattacaggtatgagccaccgcacccggcctatgcactgtttcttttactgggtagcaccatgttccctgagttctgctgtcaccctgcatttccagtaaggaaacaagcagccgctatgaactcctcttcctgggtcattgtctgacaccatcaatgggattctttggtcacatgtgatttttccagtcactggtctggtgttaatttagttagaatcaatttaacaacaacaacaacaatattaagcactttgttaatagtaggttctagggctctgtgtcaagtaccaggttttcaaatatgattttaaaaagtgctgtcaggcccgttttaaaagtggtggctcacacctcactgaggttgcagtgagccgagatcgtgccactgcactccagcctggtgacactttgggcagctgaggtaagactgcttgagcccaggagttcgagactagcctggataacacagtgagaccctgtctcttaaaataaaaataaaataaaataaagtactgtcatctcctatgggtgggctgtaaaaaaatataaaaataaagtgccgcaaaccattggccatctggtaatagtcatagacatccccagaaaacctttgggtgtttagtaagtgtgatgcatattaattcactcaacaaacatttattgctataaattgctataatattcccactatgaagaataagaaatacgctaaggacataaagagatgccgtggggaaggtccagaactgctacagaaagactggccaggaaggacctccctgggaaggagagctttgtatttgaacaaagctctgcataatgaggagccaggcgagaaaagatgaggcgggaaagagtttcaggtcaactccaaggccaggaccagcttccagagatacaaccaggggccagactccagggctgcgtagatcctggtaaggagatggaattttattcgaattgcaacaggaagccggtggagggttgataaaattctttggctgctgtgcagagcaagagtggaagcaaggatttcagtttaaaggctttgcagccgcccaggcaagccgggatattgttctctgcaaatgaacactctgtcctatctggttcatactgacattctgattgagccttacatgaattaaatgcctagtgtgtgtttggctagatgattttcagtctaaattagatcattatgtccttagaatatcaaggttccactgacctattgttgagaactcttgaagcgtttgctgtgatctagctactccgaatgtacccctttggaaacaacgtcaggcatttgagaaatatctgactagggccagaatcagaggcccatgaaatggaagaattcactggtaaagaaacagtacttagttcacagccttgttcatagctgtatccccagccctcagcatagaggctgacacacaaatatttgttgaaggtgttaatatatgagcctagtaagaattcaggaaatgctacagtgaaattttagtagcccagcaccccaaccagctgagctaagtagccttggacactagccgtggtgtttgaagactgttttttcagaaggatgggaatggacccatatctcctccaagcttggcatgcccacatccaagctttattgctgctgaaagcttcctgaactgcctgaccacggacaatcccatctctagctagtccccagcccccacctgcgaaaccctcatcctccagagatactctgaccagctgctggctcacacccagcgggcgcctggcccctcactcagcttcccagctgcctcttcctctgccccccttcccaccctgcaccaaaacaggggtgccttttgtgggagcaatcaagccctaaatcactatttatatttttcggagtaaacttaacgctgagaaagggttctggaatgactgcactggggactgaagcccatctggaaacatgaataatgtgaaatatatccctccatggattccccacaagaccaattacattatcatcctttctgagaatttctgccaattttttatggggtcaccagaaagttatatcttaagtgaaaactgcacagatttatatagggggtagttaactggtggagtgaggtatgtggaagtaaactgcaggaaactgtgatactccacagatgggaatgtgtgtcgatttggctcttcactttaggaagtggaatggattcattctgccgtttactgaatgactactgtgtgccacacactcttctaggcactgggaagagagcaataaacaacacgaatgttgccctcatggagctgatattttaatagccttggaagatgggctatgaaaggctcacgataaaatggtgcccaaagccaacatgtgacttttagtcctgtttgtggtatagactcaccgagcaatgtgaagaaactgagtttcttgcttcatcacagctgagggtgagataggtgtgctgccctttctcaagaatgtggggtggaatcgtattcattgtttgaaaactcagaataataagagatttggcatttatgtgttcgtgcatacttctctcctcaagctgcaaagttcaaccaagaggtatttggcagaaggccttttgctaaagcaatcacctgacaatgtgagtggggatctgagccagccaggttctacctccactggagaggtttgattaggtgatgagcacacattattcataaaattgcagagcggctgtaatttaccacatcatggctggaaatgatctgcctccgaggagcaatgtcaatgaagggtcatcttccctagtgtcagtagttcttaaactttagtttccaaggaagcactgcatgtgtctgtaacagaaagatacccgtttctcccctaacaactcaaaatgagaaggtctgggaaagggtccaagaattcatattttaccactatccctgctcattgggctgcaggtggttctacactcagagaacccccacgctgtgttcaccataagacagaggattcagacctctaattcccctcacccggacacaagagcatcttggctcaaacctcttctttggaagggaaggagaaagggaagctggttggaacagtttcctttactgattatagcttattcctttctctcgtgaattcagcaaatagagtttggcaactacaatgcacaaggtgcagcctacccactagagcgaggattttccaataatgaactgatgcttcccagcccctgccccctggagcggaagaagtttgttatggatgagggaatggaattaacggagcctgagctggccggcactgcactatgcgaagtgccctctcaaacaccctttcatttaatcttcccaagttctgctcctcatttccttcaagtctttactgaactatcccctttgcagtgaaactttgcaggatcaccctaaagcaaactcaacgcatcaaaagctggactcctgatagttccccccaaccttttcctcccagagtcttccctgcctcagtaaagagctatttcattctcccagttgctcaagccaaaaatggaatcaatttagttcttctgcatcccgtatctgatcacaagtcctgttagccctgcttttaagatacatccagaaccctgccatctgcccgtcttctgttgccatcacgcttgtccacaccctccttaccccttgtctgggtgattgcggtggtctcccagctgccctgccagcgtctgccctggtccctcttcttgactattcttgacccagcgccaccatgttaaaatacaaatctgatcgggtaactcctctgctccaaactaggtttccttgtcactccgagtaaaagccaaagtccttacaataacccacagggccctgacctgccttgctctcccctgtttgcctctttctgctctcccctcacttgctcctcctgcccacaccatgcagtcccaatgtggcatctttgcacttgctgttcctggaattctcttcctccatttgttcacacggctggcctagatcccgccacaccttttcataactactgctttctcagtcgggttagctggcctccctgttgaatgttggaactcatctactatttttcctatccatctttctattttgcactaacatctccatatgtttttttcttttcttttttttttttttgagacggagtttcacccttgtcacccaggatggagtgcaatggtgccttcttggctcactgcaacctccgcctcccaggttcaaacaattctcctgcctcggcctcctgagtagctggaactacaggtgcgtgccaccacgtccagctaatttttgtatttttagtagagacagggttcaccacgttgaccaggctgatcttgaactcctgacctcgtgatccacccacctcagcctcccaaagtgctgggattacagatgtgagccaccacacctggcttttttttttttttttgagatggagtctcgctctgttgcccaggctggagtgcaatggcacaatctcagcccactgcaatctccacctgctgggttcaagtgattctcctgcctcagcctcccgagtagctgggattatacgcatgtgccaccacacctgactaatttttgtatttttagtagagatggggtttcaccatgttggccaggctggtctcaaactcctgacctcaggtgatccgcctgcctcggcctcccaaagtgctgggattacaggcgtaagccactgcgcccggctacatctccatatttttctatttttattttgcttatctctctttctgatcagaatgtaagctccataaaggcaaaggttattgtccattgttccctgctatacacccagggcctagaacagggtgtggcatgtagcagaccttcaatactatttgtttgaataaatgagttaaataataaacaaatgaataaagttgcaattcccccctactctctctcttctctgacgtattttccccatagaatccatcaccctccaatatactccataatgtacatatttatcttatttactgtcaccttttccttactagaatgtaagcaccataagagccaagatttctatcctattcttaagtgtatccttatcacggagaagagtatgtggttcttgtgcttaatatttatttaatgaataaactctgtaatgtaagagtatttctgctgggcacagtggctcatgcctgtaatcccagcactttgggaggctgaggtaggaagatcgcttgagcccagaggtttgagaccagcctgggcaacatagtgagaccccacccttacaaaaaaattgtcttttagttaggtggttatagtggtgcacgcctgtagtcctagctactcaggaggctgaggtggaaggatagcttgggcccaggaagtcgaggctgcagtgagttgtgatcatgccactgcacaccagcctgagcaaccgagggagaccctgtcaaaagaaagagtatttttacagattcagagattgactcatattgagaatgagcaaattttgcgtggtcatgtacacaactagcatgcagcagaggcagggttaggatttgtttctggatgactttaagtctgtgttctcacagtacaccaccggcctggtcaagaaggcatttgaggctgggcgcagtggctcatgcctgtaatcccaatactttgggaggctaaggcagccggatcacctgaggtcaggagttcaagacaagcctggccaatatggtgaaaccctgtctgtgctaaaaaatacaaaaattagccgggcatggtggtaggcacctgtaatcccagctactcgggaggctgaggcaggagaatcacttgaacccaggaggcagaggttgcagtgagccaagatggtgccactgtactccagcctgggtgacagagcgagactccatctcaaaaaaaaaaaaaaaaaaaaaggaaggcatttgaggtgggcattaaaggttggataggggctgagcaggatgattctctctgctgtagagttcttttctgacccttctccctctccttcacctcactagccatcatgaagaacagatcaaaacttggttgggtatcccttcctctgaaaagcctgctctgaatccccatgcctggctctggggtcctggccttttttttttttttttttgagacagcgtctcattctgtcacctaggctggagtgcaatggcacaatctcagctcactgcaatctccacctcctgggttcaagagattctcccacctcagcctactgagtagctgtgactacaggcgcccaccaccacaccagctaatttttttttttgtttgtagagacagggtttcaccatgttggccaggctggtcttgagctcctgacctcaagtgatccgcccacctcagccttgtctttccttgtcacagttcttcctgcacagcctggcatgccaactgccagttcatcttttgttttctccactaggctgtaaggagtatatggaggcaggggttgtttctgtcttgttcactgttgtattagaggcccaccagatgatctggttcatattaagcaccatgaagattggttcatgtagtgaaggaggggaaggaatacttaggccaaagaaatacttgaacaggaatcagaattagcaagccagtagtgccatgcgcctggggcagaggtttcaatgggttcctaatgtgggatgtgtctaggaaggtggacatataaagatcgtgaagatcactgaaggttctggatttttttaaaagctgttatttggtaagccatctgggaatcactgaattatgttgagcaggatggcacacagtgcttctttcagcagattaatctgatactgataattcattgaaaggagaaaggggagatgcagaatctgctgcaggagccgaaacacacaggtggaaaatacttcattagaaaggtggcagtgggagcagaatggagtaaacaggtgcaagaaatattttgagaaaaattcaacaggatttagtgaataattggatgtggaagacgaaggagacaaggaaattgaggccagctctgaggctgtgaatcaggatggctggaagaatagtggtgcctttaatgaaaaaaggggaacattggaaagaggatataattggatggaaagaaaacaagtttggctgcaggcgtttcaagcttgaaacattcacagaacattctagtggacacgagttgcattggaaattcaggactagaattcaggagagattccttaaatagtctagcctctccaacagtaggtgaattaatgcttagctttccgtgggtttggctgatgtggacattgaaaaattgtgaacattgtttaaagagttgtttgagtttccagaaatatttaataatccttacttatttcatggggcaaaattctgagtaggctaaggtgtatttcacacctgttacctttggagacccaatgctctttttttttttattttgattttttagagcaggctcttgcgctgttggccaggctggagtgcagtggcttgatcatagctcactgcggcctcgatttcccaggctacagcgatcctcccacctcagcctccccaagtagctggaacagataacaggtgtgagccaccgcacctgatcccagtggtcttttcatttggctgggcgggtattaaccttgtggacatttagcaaactggtggagaaaaatatacaatgtaagtttgagaaaaatttgttcaagtattaagacaaacattttgttggcaatctttctgttggggcagatctctggggtttgggtgctgtgcataaatccacaaagtttccattatctgaagactgaaaggaagttgttgtgtagagtcagcaacttactagaattaaacttatttaggtttttccctctactaaaaatagataagcaagtttttaattctatctgcaattttaaaaaaatctgatataggctgggcatgctggctcatgcctgtaatcccattactttgggagccggaggcaggggaatcacttgagcccaggagttcaagaccagcctaggcaacatggtaagaccctgtctctgcagaaagaaaaaatgttttaatcagccaagtgtggcagtatgctcctgtagtcccagctacacaggaggctgagatgggaggattgcttgcacctggaaggtcaaggccacagtgaaccaagatcgtgccactgcactccagcctgggtgacagagcaagaccatgtcttaaaaaaaataaaaataggctgggcgaggtggctcatgcctgtaatcccagcactgtagaaggctgaggcgggcggatcacgagatcaagagatcgagaccatcctggccaacatggtgaaaccctgtctctactaaaaatacaaaagttagctgggcatggtggtgcacaccactagtcccagctactcgggaggctgaggcaggagaatcgcttgaacctgggaggcagaggttgcagtgagctgagatcacaccactgcgctccagcctgggcgacagagcgagattctgtctcaaaaataagtaaaaaagaaaataaataatatctgatatagatggggcaaaatgttaatatgttgtccaatctgggtggtggatacttagatatctgttgtattattttctaaaattattttctgtgtattattttcttctgtacagtagattgtaatttttaaaaacctttcaaaaaagacgtgcaaaacagagcagaagactgagattctgaggcttaggcaagtctgggaagatgacctgcagaagcaatagagcgaccccactttccaaagttcctgtccctctccaggaacaaaaggccatggtggtgaccgggccgttagaggtcatgggatagagagggaggtagccattcttttctcaggccgtggtcccacagtgtctataatagtcctcttgaggtcagccaccagcttgggaagtcacagctccgccaccgatggttagaaatcaacatgctcccatgtcgagaattacttgtaacccaagcacagtgacagaggagcctcctttatgtcactcccacatgatgtccctgagcctaggctaggcttggttccaaggacaaggttcctatgacactttatatcatagggcttttctgagcaaaggtgtgctggaaaagtcagcatttcccaaagctgagaaacatctctctctccatttttttttttttttttttgagatggagttttgctcttgttgcctaggctggagtaaaatggcgtgatcttggctcaccgcaacctctgcctcccgggttcaagcgattctcctgcctcaaccttctgagtagctgggattacaggcatgcgccaccacacctggctgattttgcatttttagtagagatggggtttctccatattggtcaggctggtctcgaactcccaacctcaagtgatatgccagcctcagcctaccaaagtggtgggattacaggcgtgagccaccgtgccgagcctcctcttttttgtttgttttgtcttgtttgagagagtatcactctgttgcccaggctggagtgcagtggtacaatcttggctcactgcaacctccgcctcccgggttcaagcaattctcctgcctcagcctccggagtagctgggaccacaggcacacgccaccacacccagctaattttttgtatttttagtagggacggggtttcaccatgttggccaggctggtcttgaactcctgacctcaagtggtctgccacctcggcctcccaaagcactgggattacaggcatgagccaccatgcccggcgcatctctctttttatttcttctttcagtttcttcttccattcaggcctaagctggaaacaccactgtctgataaacactggccacaccaacgacatggtaggccagggggtgatagcaatcttccagtaaatcagcttttcagtctaaacataccagtcatcctacttgaaagaaatgtgtccctggggacaacctgtgagccttagccttctgtagggagaagcactcttgatgggaggaaatttgggagcgaatatttctttcaagacagaacctaagcggaaatcctcttgggtaaagtatctcaataggctgaagcctgcctgcttctgactgtcaagcctttggaaacagtcagcatcttgcttccagttcatcccctctgcgtcagaggagcccttcccatagttccatgaaaggctccttcgggcttcctacccagctgatgggtggggagaaaggaaatccatttctcctggggcttgatgtctcttctctgatctggggcgcctccagattgctgcctcttctgttagatcacacgacaagcctatgctgttcctgccagcactgctgatcaatcccctcttccagccaacgtgccactctgcgcggcagtcgccctcctttccccactgcacgattaggaaccgtttcagtgttctcagcttttccttcctgtgcctgtcatttcccccacgaacacaagctgctttgcagtcctagtcacacacatggcaccgttcctgagacaggtcgtacgtatggtgctgatcaaattcgctgcgccaagttgccaggactttctggaacaaataacatttcacattcagctcctggagcacccccgaaaccagacctcctaaagtctgcttcatttccatcagagcttttgagtcccagatttcattctgggggatgagtgatcagagatttttaaagccacgctgactcttgccctcatttttagcttcctgggaccactggactcagtgcctcctggggtcttgggctccaaagaacatcactgagtcgtgtttctaattaaggaacgctggagaattccccacacatctccactcttccaggaactcacgtctacccctctccccgtgtatttttcttcacagacaactcagaagaacacacgggttctcctattctctatggcccagtctgtgtccagcatggcaggcaaaaaggcctggaatctcatgttgttgtgactggagcctgttgctggcacaaaatcaactatacagatctatgttgatcatcaagacaaacagaactatcttctcggtgatgttgttgctttttttgtggggggatagaaacagtgcaagtcaggcctggctgtctgtgtagcagaagaggaaatgggttccctctgaacaaattttttttaaaaactttctgtccaggcacagtgcctcatgcctgtaatctcagcactttgggaggccaaggcaggcagatcacctgaggtcaggagttcagcctggccaacatagcaaaaccctgtctccactaaaaatacagaaattagctgggcgtggtgccacaggcctgtaatcccagctattccggaggctgaggcactaggattgcttgaacccaggaggcagaggttgcagtgagccaagaccacgcctgtctcaaaaaaaaaaattaaacattaaaaagattaactttttaatgtttaatttttgtgggtacatagtaggtgtatatatttatgggttgcatgagatactctggatacaggtatgcaatgcataataatcacctcatggaaaacgaggtatctgtccccttaagtatttattttttatgttataaacaatccagttatactcttttcattatttttaaaagtgcagttaaattattattgactatagtcaccctgttgtgctatcaaatattaggtcttattcattctttctattttttttttttgtacccattaaccatccccacttctcccccacccatcttccctctgaaaaaattcagacagtcttcctgggttagtggggaatggattgtacctcctgcagtgctccttgaagacaatttgagagatgtgttctctgcgataaaccaaagaatttgaaatcttgggcttgcaggttgaaaaatacatagtatcctcatgtatgttcattacttagtgttggatgaggtttccaaagccatatgtacaaattctagagttaaaaacaaaagctgtcagagtggggaataacgtcattcaacttggccatgcaatttgcctcttgtcccaataatatatgttttggtaaaataacatttgagggacaaaaagaggatgccagatctaaattaattttagaacaaagtaatatatgccaggcatggtggctcacgcctataatcccagcactttgggaagccgaggcgggtggatcacctgaggtcaggagttcaagaccagcctggccaacatggcaaaactccgtctctactaaaaatacaaaaattagccatgcattgtggcaagtgcctgagggaggctgaggcaggagaattgcttgaacccaggaggtggaggttgcagtgagccgagatcacgccactgcaccccagcctgggtgacaagacactctgtctcaaaacacacacacacacacacaaaagtaatataaagaagcaaacacaggtgaaatacccaaaggttattatttacagatgtctcatattttcaaagcccccaacttggcagctgtctttcccagaccctgtgtagcatgttaaaaactgctgattaggccgggcacagtggctcacgcctgtaatcccagcactttgggaggccgaggcaggcggatcacctgaggtcgggagttcgagaccagcctgaccaatatggagaaaccctgtctctattaaaaatacaaaaatcagctgcgcatggtggcgcatgcctgtaatcccagctagtcgggaggctgaggtaggagaattgcttgaacctgggaggcagaggttgcggtgagccgagattgcgccattgcactctagactaggcaacaagagtgaaactccgtctcaaaaaaaagaaaaaaaacaaaactgctagttaactcttagagtgtcacagacttgtaaactgcatgatttgtttagtatcaaataaaaaccagagcctttctgatttaaaccaacactcctttccccaggttttatctcatttatgtggggcacagaaagttgcagcctttccaacataaacctctgccagcaccagctcatattaagtaaatgtgtgggatcaacaacggagcgctgttgacattttttcaggcccctcccatgcttgggtcatcaggatccaagcctctccctgagcttccagctctaaaattatatgactctagttactttggcagctattcagaggaaaaagaaaatagggaggaaggagggaaaaaaagataattactgaagcatcgtccctaaaattctgatggcattgggtaggaagggtgtttataaaatagtcgtgatcacagcagatagacatggcagtgatcagagaagcgtccttgaatagcccctgatgttcacacctccatactgacatttgttatcataacggccttggtggttaaactgagatgtgttcttaagcaagaggccccagggctgtgtggctttatcttttcccctctgaatcgcagggagaaagagcagttccacaatcagttctgtgtatttcttattatgttccttagcggttcctaaggtggtcataaagagaatgactctgttacataagacagtcactgttgaaccaggatctcccagggcctgcgtccttacctagtagcaaccgtgaaacacatgaactcttccaggcagagtaaaatatacccaaatgggtaacgactgtaattccacagctaaatgctgcttttgcggcatctaaatcaatgtgctcccccatcaaactccagcatatgagggtagaagtgtcactgcattttattttattttattttgttttattattttattatttttttgagacaggatctcactctatcacccaggctggagtgcagtggcatgatcatggctcactgcagtcttgacctcctgggctcaaaggatcctcccacctctgcctcccaaatagctgggactgcaggctaatttttaaatttttttgtggagatggggcctcacaatatggctcaggctggtctcaaattccttggctcaagcaatcctcctgccttggcctccctaagtgctgagattacaggcgtgagtcactgcactcagctggcattgcattttagacattatctaagtgtaatctttgttcacagatgcatcagaaaacaccgagtttgatcagccatctgaattagaaacagtaataacaaaaatcacaacactttagcatccaaacagttaagggaggagagccgttgttgaattctctcttgaaactcatcatgatgaggctgtaccaagagggcgatgtaactgtgggtaccggggcctgcagaaaatcccccctggctccttctgagctgccactcagggctttatttatcccacccgtatctctccttcagagtgacacagtcagcaagtcactggactgcggactgtggcatcgtggtcttttgtgttggtcttctcagcaagaacctgatttctggctttgctcagcatccatcctcccaccccatcagctatggctgtgcagtgaagctaatggggttgaagcttcagaatccctcatttgcacgggctccttccaaggccctacaaggacccttagccgtgtgtgtgtgtgtttatatataaaatttctataagtaagaaactgcaattttaggggattaagatcatttgcattctgctccaacgccacttgtgttaggggtcctagaagtggctgtgagcattttggggaattggctaacggcaagttgagttaggggtacatttagttggacttggtaaaacacagtcatctgatttgcagatgtgtctgtgcatagttgaagttattgctactcatcctgatgtaggaatggcttccaggaaaacgccctctccctgtgccaactcactgggcatcaggacatgaaggtgcaggccaaaatttgcatcatgatataaatgtgtgctgtggcttctggcaccacaagtatgtgtctcatgaacataaaacacagtttggagccagaagccagtctgggggaatattctttccaattttatagcttgtatgtatatcaagagaacttgatagaggttataccaaatttaacaacaaccttggatagaattttaaatgacaggccaggcgcagtggttcacacctgtaatcccagcactttgggaggctgaggtgggcaatcacctgagctcaggagttcgagaccagcttggccaacatggtgaaacgcctatctctactaaaagtacaaaaagtagccgggtgttgtggcacacatatattatcccagctacttgggaggctaacgcaggagaatcactggaacccaggaggcggagggtgcagtgagccgagatcataccactgcactccagcctgggcaatagagtgagactcggtctcaaaaaaaaaaagaaaaaaaaaagaaagttttaaatgacattaccaaacaaaactttcaaactatgtataagtacattgcaatccaccatgctagaagaaaaactgaatgattctattctctttagagaaaatgaaattataaaattgttttctctcaaaaggtcacctaagaatacacagccaaaaaatacaaggggtaggggagtacgatagaagtatagcaagtgggccaggcgcagtggctcatgcctgtaatcccagctacaggaggctgaggctggagtatctcttgaacctgggaggcagaggttgcagtgagccgagatcgagccactgcactccagcctgggcaacagagtgagactctgtctcaaaaaaaaaaaaaaaaaaaaaaagtatagcaagtggttaataaaatattatgtactttttggagttttatgattttgtgtgatttgttagcttttgataatgtgatttgctgtacattctttgctcattatgtgataactatttatctacataactttgtattcttctacttaaaaagggcgcccagattctgtaagcttcaggcctcccaaaacctggatccacctctgccccctgcagcatgtggtaaactgttgaaaacagtatacactaaatgtgtgtgaatcaaacgctgctccctctgcctcattaaaaatcatttccactgggccaggcacagtggctcacggtaatcccagcactttgggaggccgaggcttgcagatcatctgaggtcaggagtttgagagcagcctggccaaaatggcaaaaaccccgtctctactaaaaatacaaaaattagccaggcgcgtggtggtgcacacctgtaatcctagttactcgagaggctgagacaggagaatcacttgaacctgggaggcggaggttgcaatgaactgagatcgtgccaccgcactccagcctgggcgacaagagcaaaacttcatctcaaaaaaaaaaaaaaagtagttctgccagatgaggtggctcatgcctgtaatccccgcactttaggaggctgaggtgggtggatcccttgagccctggggctcaagaccaggctgggcaacatggcaaaaccctgtctctactgaaaatacaaaaaattagctgggcatgatggcgcatgcctgtagtcccagctactcaagatgctgaggtgggaggttcgcctgagcccaggaggtcaaggctgcagtaaactatgatcacaccactgcacttctcctgcctaggcaacagagcaagaccccgtctcaaaaacaaaaacaaacaaacaaaactatcagttcttataggtgaaaacaggaatccagatgatatgaggctccaccagatattagtgaggacagtgtgacctacatgtgattttctttgtggaaggtttaaaaacagaaacatgagcaaccttggtgcgagacttagacctataacgagggcatctgcttttccttactcaagctacaccaggattgggacaaactagagtgatgtcatcttgatttttttttttttgtcacccaggctggagtgcaatggcatggtctcggctcactgcaacctctgcctcccgagttcaagcgattctcccacctcagcctcctgagtagctgggactacaggcatgtgccatcactctggctaatttttgtatttttagtagaaatggggttttactatgttggccaggctagtctcgaactcctgacctcatgatctgcctgcctcagcctcccaaagtgctgggattacagatgtgagccatcacacccggcctgtcatcttgaattttattcacatattttgatcttcatttatttggagtgaaggcatataagttatcaaaaattaaaaataatattttgaaattttaaactgaggttctttttcttcaaagttattgactctgcccccattggctcaatggcattcattacttcaggagaaagtgaaaacagcgagaacaaagcagccaggaggtgctgagcggatggataattcacaatatctgaagccacagtcgcttgaaagagctagtcatgtgagagagaggcagttttgttctgaatttcaaaatggcttagttttaacccatttatggctgaggtggcaatttttttaatttgaaaaatcagaccttggaaatgccttgagcagtaggatataaataactcccacatgcttaccgttccaataatggaacactaggcataaataagcaagatgatagtaaaagcttgggggacagagcatagcatttataggtgttacgataaagcaacttgtccaatctgtggccaggatggctttgaatgcagcccaacacaaattcataaactttcttaaaacattatgagactttttgaattttttttttttttagctcattagctatcattagtgttagcatattttatatgtggcccaagacgattcttcttccaatgtggcccaggaaagccaaaagattggacaccctgctctaaaggatgcagctcatggcacaaggtcatttctccaccataaaagaaagcaatacaaattgctgcccaggcatggtggcacacatctgtattgccagctacttaggaggctgaggcaggaggattgcttgagcccaggagatcgaggccagcctgagcatagcaagaccctattccttaaacaaaaaaaattttttggccgggcgcagtggctcatgcctgtaatcccagcactttgggaggccaaggtaggcggatcacgaggtcaggagattgagaccatcctgtctaacacagtgaaaccccgtctctacgaaaaatacaaaaaaattagccggggccgggcacggtggctcacgcctgtaatcccagcactttgggaggccgaggtgggaggatcatgaggtcaggagatcgaaaccatcctggctaacatggtaaaaccccgtctctactaaaaatacaaaaaaaaattagccgggcgtggtggcgggcgcctgtagtcccagctactcagaaggctgaggcaggagaatggcgtgaacctgggagatggaggttgcagtgagccgagattgcgtcactgcactccagcctgtgcgacagaatgagactctgtctcgaaaaaaaaatttttttaataagcattaaaaaaatagctttcctggcactgcaaaagcttactgggggaggggggggaaataaaggctttcctgactcagcacccagggaactggggagcagaaatgggggaggagagaagagttgtaagagatacagacagaggtgtgcttgttcccaagggggcggtggctctgcctccttagccgacatttcactggcaggggacagagagtacaggggtaagggcagaagggacgtggcccttgtttgctctaaaacccttgcttccagcaccacaagaacatgagaggggagagaagcagagcggaaaggcaggcagggcagacctggactgaaaatgggcctccaagaaccgccccacctgagtctcccctacttccttcctgtgtggggaaatcaggggaagagcccgtagcgcctggtgagggtgaggaaggtggcagagaatgaagccttggccagagcagcactgccactgcagtgacggggcctggccggcagggaacagccacctctccttttgttgcctaagagcagctgacaaactgggtcaatggtgaaggcaacagtgaccaagactgacacgcaccaccaaggcaacaagatgtctccaaggccaaggggggccggagaacaggaagcatgggacagacctggggctcatccagaggaggagatgagggagtgtggccctgatggaattaaaatcctggattgactgaggaattaccctaaagaagctttgaaaccagaagggtgtcagttatcctaaagtgccaagatgaagagttttccactacttcataagtaaattgagtacagttatagagaaataatgtttcatttttgcagctctgagatgtcactgtaaacttgaaacccactacacattagaaatacctgccctcaggccgggtgcggtggctcatgcctgtaatcccaacactttgggaggccaaagtgggcagatcacgaggtcaagagatcaagaccatcctggccaacatggtgaaacccccgtctctattaaaaatacaaaaattagctgggcgtggtggtgggcgcctatagtcccagctactcaggaggctaaggcaggagaatcactcgaacccgggaggtggaggttgcagtgagctgagatcatgccactgcactccggcctgggtgacaaagtgagactctgtctcgaaaaaaaagagaaatccctgcctcccttttatgttcccaaaatgttcccaccacagaggcagccttgtacactgacaatttgcctacatttggtggggtgtgattgcaagaccaggaccagacagcaatcagcactactttgagcttccagaaatctaatctggggaagtattcaggcaagagatacattgatctcttatagaggacacaaagacatgaacattgatagccctgttgtcatcttaaaaatcataattaggccaggtgtggtggctcacacctttaatcccaacactttgggaggctgaggtgggtggatcacctgaggtcaggagtttgagactagcctggccaacgtgatgaaaccccttctctactaaaaatacaaaaattaggcaagcgtggtggcgggtgcctgtagtcccagctactcaggaggctgaggcaggagaatcacttgaacctgggagatggaggttgcagtgagctgagatcatgccattgcactccagcctgggagacagagcaagactccatctcaaaaagaaaatcataattactttcatgatgtgtactctaaggcaatctgataagtagtagggtatctgttctttccctcatttctctcccacccttactctgactggtatcttggaagcagaaaattctaatgcaatatttgctatgagtgttgtctttaaatgtcatccacaatgattaggaagccctcacagacaccagccctgtttagctgggtgcagccgaccaggtgttcaaccagtttgactactccgcctccctttgttaggcctctgaattatttatctcctggtatgcgagtgagagactcagactgtggctctccacatgccctggagctaaacgtccttgtttgttttctccggagtaatttcacttattcccctctcccctctctacaaggaagctgtggttcacaggtatccatgactataatgattcatgaggaatcgaaataaaggcattacaaaccctctagataaaatgaggacattctttaagttctattataaattgagtgtagcccaagaattcaacggagaatgaataagagattaccggttgtctggttagagattagtggttgcccccagggaatagcttgttggcttgtgtgggcggccagaaaacacggcagcctcagctctctttggagtccttccttcagagaggaattgacttcctagcaattcatttccccgtgattgtggcccatgctcacagaggccaaaacaaacaggcccaggaagattcttaccgtggccagtggagagcccggcctggcagcacccctcaggcttcgccgctgccttgtgtgcatcccaagcaatctttgtcagcatccccatggccacaaaacttcctttttaaaaaaaaaacgaaaaatgtagtttaaatgttcacatgcacatcacagctaacttctattacctttaaaaatgcttttaaattttttagactttatttagtgtaaaattaagtttagcccaatgctgcctccttatagtttacattctgcctaaagctgtgctcatgcatagtgcactgtcacctgacagggtgtgtaaacacacggctgcctactcttgtgtcaatcacccagttccggccaaaggcgggcagttcttcaaaccatgaacaaacaaggcaatcatccagcagtaaccagcctggctctttctgtgcctcgcttctgtttcctgtacatccctttcctttttctgtccgtaaatcttcctccaccatgtgcctaagctggagcttctctgaacccattctggtccaggggctgccctattcacaaataattttttgctcaattaaactctgttaagttaaacgtctctgtggtttttcttttaacattagagacagggtctcactctgtcacccaggcagtggtgcaatcatggctcactgcaacctctatcttctaggctcaaaagatcctcccacctcacctcccgagtagctgagaccataggcatatgccaccacacctggctcatctctcctttgtaatgccttatgttttcattaaaaaaaatatactcttaaggctgaaagttcgtttagactaaacatagcttgaggccccttgacagcacccctggatgctggccatccagtctcgaatctgaacgtcttcagtgacagggaggtaacttgctccctcccaacatagactcatccacttttgggttgctccagtggaaaccctttcttagactgaagattccctataatttacatcaattgtacctaatttcatgccttgacaccccgtgggataaatcgtacccatcttccatgtgaaagctctgtagaaaattggtgaccactatgtcatcactccccccatggcccttcttcatggccgagctcctgcggtggtatcattcttcctctacgaaggggctgagagtgtctaccaccccgctgctcccctctgaacagcctccaactcgtcgagccctttgaaaactgtggtgcacatagcttggcacagggctcagctgtggtctctccagtgcagaatgaggcagaaggctttgttggaaataccatacatctattaatgcagccaaggatttaatgagctttcttggcaaccacatgaaattatggctttttttcttaccagcaactacatatttgagtggttggattttgtaaaccaagaccagagccttccgtttaccattatggactttatcttgtaatatgggctgattcattcagacttttagagatcttctggggttttgattttgcccttcaatgtattagtattccactcattctctgtgtcacctgcaaatacaacaagtttatttttggtctttggccaagccactgataaaacaaaaacaaaaacaaaaaaacacaacaacaacaaaaaaccctcatgtggcacgataatgcagagttctgtggtattccaataaaaccagtcctctggattaaaaagaatcaattaattagcaagctttggctatgatccttcaacccgttaaaaaccagcacaattaccctatccctcaacccctgtgaggacaacattagccattctttacggcagctcatcatctgaccccactttctgcgtgggagaattccctactttgcgagtctgtcagaaggcagagaccacctcctcccatgagaagtgaaacaggtcagcatctggctttcccagctccctccatagctaaggtgtgggcatatgatctgggctccaccaaacagaggcattgggctgaactttgactcaggagctggagaggcaaaaacgttgggactttaaggactctgttttggcagaggatggggacagctttatacccttttcaggacaccagggttagtgttagccgtgtcagcagggcaaaccttggtgttcatgccgatgttgacaagctgtcatgccctccaaagaccagggctgtgattgtggatgcggctctgcatccaaaaatccataaatcacatcagatgtaggatatctgagcctgattgtctggcccttctggacagctggtaaacttccctatatccttgaataaaatcccttttctgtttaaactcactagaatttgtttctgttctttgtgacctaaaagctgcgagtgatactctgcctctgtaccttatccccagggcacccaagcaactatgtcagtttcctttctgaagtgtagagggaccatatccatcttgtatctctaagtttgccagtggagtaatcctatcagaaaaggagatggaatcaggctaacacaatttgcttttagtgacatggggctgactataatcactgcctgctggtttctaagagctcagaaaccaccttctagcattctcttcaacactctcaccaagaatcaatctcaagcttactgatctataggtcatagaacccaccttctttttctttttgaaaattagaattacgtatttcccatctctgtggctcggttatttttcataattcctagagatcatccaaaagatttcccaatcacctccacaaattctttccattttctttactatgaaaatattctcataccatctcctcataggtttgatttgttctttttgatttgaaaaatgttcttttttgagaagacagaagcagagcaagagttaaggaattccattttctgtgttatgtttgaatattgcattgtccagttgacactacagacattcctcagaacctgtcctagacctgcagacaaaggcgaggcatagcccatctctctgcaatttcaaatatctaaacccaaaccccatgccctccagtctaaatacactgtcttagtccatttgggctgctgtaacaaaataccttagactgggtaatttataaaaagcagaatgtggccgggcgcggtggctcacccctataatcccagcactttgggagcctgaggtgggcagatcacttgaggtcagcagttcaagatcagcctggccaacatggtgaaaccccatctctactaaaaatacagaaattagctgggtgtggtggcaggtgcctgtaatcccagctactctggaggctgaagctggagaatagtttgaacctgggaggtggagtttgcaatcccagctaatctggaggctgaagcaggagaatagtttgaacctgggaggcggaggttgcagtgagtcggagactgcaccactgcactccagcctggatgacagagcgagactcaatctcaaaaagaaaaaaagtgcggaattttattgctcacagttctgaaggccgagaagttcaacatcaaggtgccaccggattcggtgcctggtgagggccctctgcttcatacagggcaccttcttgctgcattctcacatggtggaaggaggaaaggggcaagcaaactccctcaggcctcttttatggcgggattattcccattcacgagggttctgccctcatgacccaacagccccacctcttaaaggcaaaacattggagattcgatttcaacagatgagggagtctctgagcctactctagctcagaaggttacctgccaaaaaaaaaaaaaaaaaacaaggaaagaaaaagaaaaaaaaaagaagatttcaacatgtgaattttggagggatgcaaacactcacaccatagcgctgtccttgaatatagtatgtgccttatgaatgctagtggcataaagctaacaaaaggctataacttatcccaggcatacctgcttggcttttgaacctcatttctgtcactgtacacttacagcctaccataaaaaatattaatgatcacataaaaggtggtttatattatccaggtcttatttagtatcattaaacatcactgttagtctcatttaatatagctaacttataattggccaaaaaaagcattgcaggccagatgtggtggctcacacatgttatgctagaactttgggaggtcaaaacaggcggatcgcttgagccccaggatttcaagaccagcctgagccacatagtgagaccttgtctccacaaaaaattaaaattaaataaggattgcaggccgggcgcagtggctcacgcctgtaatcccagccctttgggaggctgaggtgggcaaatcacctgaggtcaggagtttgagaccagtctgaccaacatggagaaaccctgtctctactaaaaatacaaaattagacgggcatggtggcacatgcctgtaatcccagttactcaggaggctgaagcaggagaatcacttgaacctggaggcggagtttgcggtgagccaagatcgcgccattgcactccagcctgggcaacaagagcgaaactccatctcaaaaacaaacaaacaaacaaacaaaaaagcattgcaatattattccaaattgttttttaaaaagcacaagtcttaaaatcataattattttttttgaaacggaatcttgctctgtcccccaaagttctgggataactcccaaagttctgggataacaggctggagtgtaatggcgcgatctcagctcactgcaacctctagctccagggttcaagcgattcttctgcctcagcctcctgagtagctgggattacaggcatgcaccaccacgcccagctaatttttgtacttttagtagaaacagggcctcaccatgtggccaggctggtctcgaactcctgagctcaagtgatctgccagccttggcctcccaaagtgctagaattataggcatgagccactgtgcccggcctattttttagttctaaagcatgcgtatgttcaatactcagttgctttaactaaaggtttcatttttctattcactcaaacaagtctctctgagatggctactttgtagaaggcacattctctaactctgcctgcttttcaattcaacccagcagcattctttcatgagaactaagttgttagactgtttggtgtcctggaagtgttaagtgactccaagatgtggagaagttaagacaccgtgaagtgaccagggctccttggtggaactcagttgtttcttctgcttcagaggctgggttccatgaagcgctccagaagaattctccatacatcacgcccagaatgcctctttttcttctaaattcccaatgaaatgatctcaagaaacctggtttaaaaaaccatatatacatatatattttgagatggggtctcactctgttgcccaggctggagtacagtactgcgatcacggttcactgcagcctcaacctccagggctcaagtgatcctcctgcctcagcctcccaagtagctaggactataagtgtgtgccaccacgccaggctaaattttgtattttttgcagagacaggttttcaccatgttgcccaacctggtcttgaatgcctgggctcaagcaatctgcccaccttggcatcccaaagtgctgagattacaggcgtgagccaccacacctggcctaaaaaacatacattttgatataaatattccaaagtgtgtgtgtgtctgtgtgtactttaaaacctatttaattcctagtaggtaagggataatgtcattcacttgactgaaacttagattgaggccaagatcagagagaaagaaggaccagccaggtcatgatccattgcactggagggaagaatcctgcctttgagaaaggaggcaccctcagaaggagcctactgatctctctggttggggtgaggtggggtaaagctgagaggaggccatgggccattggaaccatcccagcttgccccactgatgcctcttagcttcccggatgccggatcccatgccagggagacttcgctgacgtgctcgggcttaccctgagcatagacgggctgctgaacgagtcgcatctctctcaacccaggcttccaggagggcagctgcataggtagagaaaggccagcaccctggataatttcagatgggcttgaggcatgtgtgtgacgggtgccttttaaagtagcaccctaccagaaatggactttgtgtcatctccttcttggtaagagtggaagaggggaccctcccttgcaggagtaggtcaaggatccacattgtctggagaaaaggggcaaactcacaagacactttgggctttcagggtttaagaagacacctgctcagttcccaggagagtagatccctggacagcgggtgtgggggatggtcttggtccacagggtggtgataatcagagcgggagatcatcccaagccggggtcctggcggcgctgctgcatcccacaggttcaggaggtatcattccctcagaagccagaaggaacggtgttctctgcggtggtacagagttgagtcctatttcctggggtgggttatgcccctggggtgaatgtacttatgatgaaagagttggtccctaagagatagaacactctgagcttgggcctagtagggagtgaggtcccagcagccaagcccggttgtaggcagtcactgtgtccagaactgctgcaaaagggcttggttctagcctaaatgctacagcagggaaagaagacacaaaattcagaggcaggccggcatggtggctcatgcctgtaatcccagcactttgggaggccaaggcgggaggatctcttgagcccaggagtttgagaccagcctaggcaacatagtgggagcctgtctctataaaacaaacaaataaaaaaccaccaccaacacaacaacaaaatccagaggcagatgcaacccctaccctagccccttctactgagaagacccaaacactcccaactccttatccacctaccaccgtgactctctgccacgctacacccctgagctgacaaggaattgaaggagtttgactcaaagttcctggaccaatttagctgacctcttccttgactgagagaaaggcaatgtgaaaggtcttcacctaaatgtctctggccagttagaccggaagagatggcagcacaaatgctgagaccaacttccgtaggagtcactgcctctcctgaatgcccttggccactaggtgagttctgggctttgtccagctccaggctcaggacatgacttgctgacaccaggctgtatgcctcaactcctctccaccctaattatatgtagacatgggaccaagcccatctggacccaaccaagctatgaggaaactcttggatgcgtgagaaggagggcactggggcatttcagcaagactgacatctaaattttctgcccttatagggaggaggttcttgaacacttgctccttggcggtaaaatgaatcaaattattcctacaagaaaacgttaggtccaaagaatatggttgcctttggtattaacaacttaccacctgcacttatcgttatctgtaagatgtcactcatgcctgtaatcccagcactttggaaggccgaggcgggcggatcacgaggtcaggagatcgagaccatcctggctaacatggtgaaaccccgtctctactaaaaatacaaaaaactagcctggcgtgggggtgggcgcctgtagtcccagctactcgggaggctgaggcaggagaatggcgtgaacctgggaggcggagctcgcagtgagccgagatcacgccactgcactcccacctgggcaacagagtgagactctgtctcaaaaaaaaaaaaaaaacaagaaaacaacaacaaaaaagaaaacgacaataaatctaaatatggctgggcgcggtgtctcacctctgtaatcccagcactttgggaggccggggcgggtggatcacctgagatcaggagttcaagaccagcctgaccaatatggtgaaaccccgtctctactaaaaatacaaaaatgagccatgcgtggtggtgagcgcctgtggtcccagctactcaggagactgaggcaagagaattgcttgaaccagggagggagagactgcagtgagccgagatcacaccactgcactccagcctgggtgccagagtgagacccatctcaaaaaaaaaaaaaaaaaaaaacaaacaaaaaaaaaaaaacaaaaaactaaatacatcccttctccctaaggttggcagcagaatccacaccattctagaagaacactttttttttttttgagatggagtcttgttctggcatccaggctggagtacagtggtgcaatctcagctcaccgcaacctctgctgcccaggttcaagcaattctcctgcctcagcctcgcaagtagctacagggatgcaccaccacgcctagctaatttttgtatttttagtaaagatggggtttcaccaggttggccaggctgatctcgaactcctgacctcatgatccgcacctcggtctcccaaagtgctgggattacaggcgtgagccactgtgccccgccattttttttttttttttttttttttttttttgagatggagttctgcttttgttgcccaggctggagtgcgatggcgtgatctcagctcaccacaacctcggtcgcccgggttcaaacgattctcacccgcctcagcctcccaagtagctgggattacaggcatgtgccaccatgcccagctaattttgtacttttagtagagaggggttttctccatgttggtcagctggtctcgatctcttgacctcgtgatccgcccacctcggcctcccaaagtgctgggattacaggcttgagtcaccgcatccggccaaggacacatcttaattccccatgatcagatatgcacagactcccttctttaagaataagcaagatcacaacagacagaaaatcagccaggatggtggctcacgcctgtaatcccagcacttagggaggcagaggcaggaggatcgcttgagcccaggaagtcaagaccagcctgggcaacatagcacgaccccattctccacaaaaggggggtaaaagtcaacagacacaggaaaagattgaacagtgcaaagctgaccgatctgaaacgccagactaattggcccctttcaaagaccactgcaagaaactggagaaatgcttagaaaacgttcactttgtattctccgtgaataattacagaagagagagagggagacactgcaggtgggcctccctctgtggcttcctcatggatgcctgagtcacccacaagcagaggagcagggctgggcccgggtatcggagctggcggcaagaccacatgggagagccccaccctccgcgctgcctgacactgcataggtggcgaccctgtggcagctctgaccgtccctttctttttcatggttgtgtgtgataactgatcaacccagaacggaaggaacaggtgggaaatgtacaagcatgggtcacggggttggggggccggaccttgagtcacatcagataacgcgcccgtcccaggtctcccagcccacggtgaagccagcactgtgaggccagctttagtctcccagcgtttacacacaggaacatgctttgcaatttgagacacacaaatctgtggtctggacttgctatctttgaggatcagcaaagaattgtctggctcccgggatgtttttgtgctgcaaagcagaaacacagttctgggtacttctccattttgtcctgtcaggaaggaaacatttttaaaagtcaccccatgttcatgatcttgagaaatccccagcagagttaatagacatcacaagaactgcagaatcaacaacaatgtgtgtttctttcctctctgtggccatgtgcccagagtgagagatgtaatataagaagcagagaaaattagagatggaaaaaatcgcagagagggaatgactggccaagatgtgaatcctaatagcaaatggagatgcttgtaagcattcacagcagcaagcacttgccgaaattgctactcataccaggagtgtaagttctccgcacacaattatgtgaacagcacagtaggtgaggtgatatgggactattctcagaaatgatctgctcttattttgcacaagaaaaatcaatgtaaggaaaatattgtcatatttatccatcaaacgtcatgcaatgttcaatgagatttttatatgattttaaagacatccttttttatatgtcaatccccatatgatctgccagcaggatttacacatcactgcacacattatagtgagaacacagaaattttattttaactctgattgggtctacaagatctttgcattcttttcctgaagaaaaatagctttttctttcttttttttttttttaacagaagaggggaaagggccaggatggctgccaagaacttcttggtttggttccaaagcattttgagcagaatctctcagaatgtcaaatgtaacgtcccgttcagggattcagtgggattgttggtgatgtgagaagagattgggaaatagaaagttctttctcagttcttctctctgctatagtagagactgttgacttctacttctggaaactcctctcttagcttcaggacttattctgatcctctcttcctaccctgttaccaaaggaaaaaaagaaaaaagcttctatgacagtcctcttcatgatgcggttaactctctgtgttttcaaaccacagccattggtcactggcttgtccacctacatataccccttttccttaaggcaaagagttcgagatcacccaactggtatttttctgtcaccctactttaactcaagattcatattttcagctgcctataagacatttacattttaaactcctgtcatcatctccaactcaacatttccaaaataaaacatactaccttgacctggaaatacacttcccatacaacttctggatccctccccaccaaccccagcctgccaccactttttttttttttttttttgacagagtcttgctctgttgcccaggctggagtgcagtggtgtgatctcggctcaccgcaacctccacctcctgcgttcaagcaattctcctgcctcagcctcccaagtggctgggactacaggtgcccgccaccacgcccagctaatttttgtatttttagtagaggcggggttttaccatgttggccaggctggtctcgaactcctgacctcgtgatccacctgcctcggcctcccaaagtgctgggattacaggcgtgagccaacgtgctcggcacctgcatccctttcaaagtctccaccattgccacagtcatcttgctataaatcttaggtgtaattttttttttctcctccatttgctgtattcatttggctatcaattcctattggctcttttttctaaaatattagtatctcttctagctttactttcctctccactcctctgccacctgctgtggtataactctttgtgatcgcttcatgatctcatcttgattccgctggccctgcttctctctctaactccagtctcatgtaccagtgcctatctaatctttccgccatgtcacttccatatgcagaacccattagtaacatcaaggtaaaacttccacttggctttttttttggagggggaggacagaatcttggtctgtcgcccaaactggagtgcagtggcgcgatcttggctcactgcaaactctgcctcttgggttcaagtgattttccagtctcagcctcccgagtagctgggattacaggcacccgccatcacacccggctagtttgttttgttttgttttgttttgttttgttttgtttgttttgagacggagtctcggtctgtctcccaggctggaatgcagtggcacgatcttggctcactgcaagctccgcctcccgggttcacgccattctcctgcctcaacctcctgagtagctgggactacaggcgcccgccaccatgcccggctaatttatttatttattttttagtagagatggggtgtcaccctgttagccaggatggtctcgatctcctgaccccgtgatccccccgcctcggcctttttttttttttagtagagatggggttttgacatgttggccaggctggtctcgaactcctgacctcaactggcccacccgccttggctcccaaagtgctaggattacaggcctgagccaccacacccggctcacaataccttttactgtattagccaaacacaaaatggattgtgagaactcactcaataaatctgtaattggtttttaaatataataggatagaacacatgtatattaattttaggcaaataaaaagtatatttcagccctttaagaatgtgaatctagccaggcgcagtggcttacgcctgtaatcccagcactttgggaggtcgatgcgggtggatcatttgaggtcaggagttcgaaaccagcctggccaacatggtgaaaccctgtctctactaaaaatacaaaaattagctgggcgtggtggtacatgcctgtaatcccagctgcttgggaggctgaggcaggagaatcgcttgaacctgggaggtagagttgcagtgagttgagatcgcgccactgcactccagcctaggtgacagagcgagactctttctcaaaaaaaaaaaaaaaaaaaaaatctgaatctaaatggaataatttgtcttttccccacactgatttagctgtgatgtcctcttttattattccagaatcctgatcatgacttggttacaactaagactaaagagatagaaaaggccaaaacaaactacaaaaacaaaaacaaaaaaaaacaatggccgggagcagtggctcaagtctgtaattccagcactttgggaggccaaggtggaaggattgcttgatcccagggcaacatggcaaaaccaagtctctacaaaaaatttaaaaaaaaattagcggggcatgatggcatgtgcctgtcatcccagctactcaggaggctgaggtgggaggattgttgagcccaggaggtcaaggctgcagtgagctgcctgggcaacagagtgagactctttctttaaaaaaaaaaaaaaaaatgcttttcagatgggaatttatggggagtagttgagaataccatttctggatgaggacacttggactattccagcggacatccagctccattaccaacaccaccactgaagagagtgttgggggctggggagcggaagagaggagggtagggtcggcagagatgcagacatagggagacagacagggagaaggtgagataagggagaaatagaagaaataatccaaaacataggacttttttttagaagaaaatgtaaaaatgcattctctggcataaggaacagtttaggatcatagggtaagattttgattttaaatgttttgaggccattttctttaggcctaagccactgggtagatttagatggtgggagagattattacagctttctcatgggaagcatttcctttgcgataccctcttcttgaaagcttcactcacttcggttttattatagggaatgactgataatatgccaatcccacacatctgtctcagtgggtaaataaatcacaggaaagaagaattttggtttaaagggtagaaattccagcccgactttgatttctgcaaccatcagcacatcataggaatcccacaattgctaccccagtagaatgggtagtgccagctatatatggagcctgccttattgccatggtggcctgtgccacagggggaggcaggcagctcacacctcctcagccccgcaggagctcagcaattcctttccaggaaggaatgaaggaaggaaggatccttcactccttacctgggaattgtgtccttgcaggttgctatttttcatgggcttggctgcttgagcaccctgggggcccatataatacatgaaccacttttcagcaccatgtctcttaaattattctctgtgtccatctatatttactgtacagagatggtttcaacaaacaaggtggtctcatttgatatggagttaaagccagcagttgctttgcacagaagatccacagatttggtggtgctgttattttttaatgtttatctaaaacataaaaaggattttactcatgggatcctcacccacaccccccagttctcagttagaatctgtttttaacaggagctcttactaaaccttagtaagaaaggaaaaaaagaaagaggagttacaaattatgactccaggggctggctgaattagcttatattagagagtgagctggcggcaggtatcagtctttactgtgtttctgcctctagggagtttgttgaatgtgcttttgcgatgtaatttataaggaaattggttttacccaaaaggacgtttttgctttatgtcttgcagcaccgttgagtgcttagaaaaaaggagaaggtaattccattaagctttcaattttcactggcaaaagaaatgaactagatgtgattggaaagataaggcactggccttcacttgaatgaccttgctacaggggttggggaataagaagcatggcctttgttccagagatgtcatttcatgtttaattagagggccagagtgccatttttcttctttataaaccccaatctcaccctgctgagaaaatatccattaagttcacagtaggcagatcatcggatcatcatcctaacaattttgggagtcatgtgctcatgctggtgacgcttcgtgaactaaagagcatgggcaggccgggtgtggtggctcacgcctgtaatctcagctcttgggaagccaaggtgggaggatcatctgaggtctggagttcaagaccccccagcttgggcaacatggcaaaaccccgtttctactaaaaatacaaaaattagtcgggcgtggtggcagacgtcagtagtcccagctactcgggaggctgaggcaggagaatcgcttgaacctgggaggtggaggttgcagtgagccgagattatgcagtggcactccagcctgggcgacagagcaagctcccatttcaaaaaaaaaaaaaaaaaaaaaaagcgcggtcaatgttaaaatcgagacatgcatggaagagacaggcctgatgtttgggaaagtgcagatcgcccttgcatggaagtcagcagtccattcagccaaaccaaaaggtttcagtagaattccccaattctcttactgaatccactctcttcatctattttttgaaggacataaggcaaaagtaacttcaaaattaaataaattggctgggcgcaatgctcacacctgtaatcccggcactttgggaggccaaggcaggagaattgcttgagcccaggagtttgagaccagccttggcaacatggcaagacccagtctctacaaaaagttacctggggcgtagtgacatatgcctgtagttccagctactcaggtggctgaagcaggaagatcgcttgagcccaggagttcgaggctgcagtgagccgtgatggtgccaccgcacgctagcctaggcaacacagagaaatcctatatcaaaaataagtaggccaggcatggtggctcacgcccgtaatcccagcactttgggaggctgaggcgggcagatcacgaggtcaggaaatcaagagcatcctggccaatatggtgaaaccccatctctactaaaagtacaaaaattagctgggtattgtggtgtgcgcctgtagtcccaggtactcgggaagctgaggcaggagaactacttgaacccgggaggcggaggttgcagtgagccaagattgtgccacagcactccagcctggcgacagagcgagactctgtcttaaagagaaaaaataaataaataaataaaattaaggaaataatctctgttgctcaaagttaagatgttttcatgtatctggtagggtttctaacacaatcaagttctaaactggtgcctccaaatgagaagctggatacagtactgcaatgctgtgtttttgtttttccctttttgtgggtgatcacttaaaaatagagtttcgggaaggcacggtggctcatgcctgtaattccagcactttaggaggccaaggctggaggattacttgaggccgggagttcaaaaccagccttggtaacatagcaagaccctgtctctatacacacacacacacatacagtattttattctctaaaatggaactgtccaaaatggtagccattagctacatggctatttaaatttaaactgggccaggtgcactggggcatgcctgggggtcccagccacttgagaagctgagttgggaggatcgcttgagcctgggaggtcaaggctgcagtgagctgtgattgtgccactgcactccagcctgggtcctcattaccatccccccacccaaaaaaataaaaatacaaataaagaataatttaaactgattacaattaaatccaataaaaattcacttcctggcttctttggtttcctggtaaaaaaaaaattcacttcctcagttaccgcagccacatttccagggttcagtagccacatgtggctagttgctaccatatcgggcagcacagatctaaaacatccccatcactgttccaaggagttctgttggatagtactgctctaggaaagatggataaagtagttctcctatgctgacatttatgtattcagaatgcccatttatgtagcaattcaaattcaatttttaaaatgtcatcagatttttttttttttttttttttttttgagacagagtcttgctctgttgcccaggctggagtgcagtggtgcgatctcggctcactgcaacctccacctcctgggttcaggtgattctcctgcctcagcctcctgagtagctgggactacaggcccgcaccaccatgcccggctaattgttgttatttttagtagagacaggtttcatcatgttagccaggatggtctcgatctcctgacctcgtgatccgcccacctcggccacctaaagtgctgggattacaggcatgagccacggcacccagccatcagactgttctagctatcaattaggccttgcgatttcatggccacctgaatgcaacagattggtctccttcaatggtgcatcttcattgactctaccttcaaatataattgaattctcttaaacttgagaatctgcagaaagagctatagaaagcttatagtcatagtgccagcaaggaccctctgaatttcacatcttacttgctttctgctttgttgagagaagtcttgtttttcgttgtttctattcacccttctgcctgaagaagctctattgagggggtgtggcattaaggctggaaggctgctttgttccacacgaaccaacaggagtgggcaaggtctatgagctgatatttgccaagcagacaacccttgcacttactctctcatcttccaatacctggatgccaagctacgtgttgaagatctgagtctgtttccatggacgtgtaagtaacgtgcttaactagaactgctgacaacccctctggcagcttctgtaccaggagacacaggagtgacagccacctgtggaagtcctgccttgtttcaggtttgtcctcagatgagatcccagtttggatgcgtgtaccataggttcacctttggttgatacttttcctgaacttcacaccattggaaggagcctctcaggggttctgcatcttgggaatacatgcagaggccccagtagcatcttactactgatttagatacatgtccaatttatattgtaaggcctttttcatgggttccattgcaccataaaatatgtcagttggttctcaatttcccaaatggcaaagaagtagaagttaatcctttgtggaaaggcaacctcagggctatcttgaatccttaaaggtagtgtgttctgaatacttattaaaggaggagaaattcggtatgactgtctaaatgatgtcatttttctgtctgcttttgaactcagtcattaaataattaataattctcaccaaagtgggtatcccttgttttctaagttaatttcaaatatctcattttcctaaagcaattttaatatttgtctcctcccttcttcactctcccttcaaatatacagcttccataggtcaagggctttatttttgatacaggagttaagaagaaattacttagatagacagtgagggtaggtaagtccttgggtgaggcttttatttttaatgaaaaacagccccaaatcattttttaacaaagagcagcctgtaaaatctagttgcaggcatagatgccggcagttgtgccaatcatgttcaagatggcagctccatcttcccttctctttgtcagccacatgtaaagtaaagaggagacaagatggccccgggccaagggaaaagttcatttgcataataagattagggtggggtggccagccttccatgcacactatgcaaaccaatctgtgagccttatgtaaatcagacaccgccacttcaaacctgactataaaatccagcacatcccctgctggccggtctttttcctcttggaagtcccctctctctcactagagagctgctttcctttctcttgtctattaaacctccactcctaaactcctcgtgagtgtctgtgtcctaattttcctggggcgagaagacaaactccaggtatttaccccagacaatgtagccacttcactttgatgtgtctgttttctgatgagactttaatgtactttaagttagcacaaggtcccatcttcaatggtaatgcaaccatcattccagtttctttcgagtgtatctttccagatattgtattcatatagaagtttattggtatatatattctctcccctccttttactaaatggtagcacactctaccttatcttttttgtttagctatctcagagatgtttccatacccatgcataaagaatttcctcattcttttttatggttatgcagtatactgctgtatagatttaccataatccatttaaccatttccatattggtaaacatttaggttgtttccaatattttgctattataaacaacactgcaaagaatatggtactgtcattttacacttgatgaataagtatattggaacaaattcttaaaagtagaatgggtaaacaacacttgtaattttggtattttctatctatattgccttccctatacattgtcatcagcaaaatactgaatgtccctcatttagccaacatttcaaatttttagaaatttcccattttataggtaaaaagtatttcattgttgttaattgcatttacattacgaattaggtggaacatcttttagtgtatatatatataaataatatagaaataatatttacataaaaaatatatttttaatgaactgtcagtttatattgataccagtcaggttggtggtggctaagactacagtagcttggactcaagaggtttattctcaaataaatcatatttaaagatgagtagttcaggctggcatgaaggctcaagtttactagggtatcatgttccttccttctttctccaacaaattagtacatctcttgcatcttaaaagtcactgttatatgtaaaacgtttatttagaaacagaatgcttgttccttggtactgcaaggaaaaatcagcattcagacaaaaagttctctcagtgagacaattttactttctgcagaaagggtgctcttcgcagatggaacaatggcgagagcacacctgaacaaaggagggaagcaatttttatcccttacgcagcttgtccctgctactgtgtcctgtgtccactggctggagccagaccgcacaatctaaactaaaacctgactggctaataatttaaaactgtcctaaataggtaaaggcaagggagaacgaaggaaaagaggaagttgcttatgccaaatagggaaggggcataagctgcaagctggaacgtgcctgtgagcatgtctagcacaaatatcttggttaaggtacaaagacatagaatgtcttatgtgccttgtgagcatgtctaacagctacataggctagggcttaacaaagagttattagcacaaagcaaggaggcttggaggaagttagtctttaaattatttctaacatttatgatttattattatcctttaacaagaagggaaactttgaagaggaaactatatttactttctacaattctacaataaattgcttttatttagaaagggtgctcttgccattgttccatctgctaagagcaccctttctgcagaaagtaaaattgccttgctgagagaactttttgtctgaatgctgatttttccttgtagtacctgggaacaagcattctgtttccaacagtcacctatgttctcacaataactattaaaaaaaaaactaaaaaaaaatttttttttaagtttttttttttttgagacagagtcttgctcttcttgcccaggctggagcgtagtggtgcaatcttggctcactacaacctttgcctcccgggttcaagtgattctcctgcctcagcttcccgagtagcggggattacaggcgtgtgccaccatgcttggctaatttttgtatttttagtagagacagggtttcatcacgttggccaggctggtcttgaactcctgacctcaggcaatccacccgcctcggcctcccaaaatgctgagattacaggcgtgagccactgcgcctggcctcctctcccttttaagaagccttaccagaagttccctgtgatattttcatttgtgtctcagcaagaacttagtaacaaggctgcacctaaccttaagggagactggaaaatgagtttttttgttttgtttttccgagactgagtctgcctctgcggcccaggctggagtgcagtggggcgatctctactcactgtaacctccacctccgggttcaaatgattcttgagcctcagcctcccaagtagctgggactacaggcatgcaccaccacaggtggctaatttttgtattttagtagagacggggtttcacaatgttggttggccaggctggtctcaaaactcccgacctcaggtgatctgcttgccttggcctcccaaagtgctgggattacaggcatgagccaccacaccctgacaaaaatgagctttttaactaagcacaaagcccagatatcagttaataagaaaaaagaaaatgaaaatattcagagacaattggcaatttctttttttttttttttttttttgagacggagtcttgctctgtctcccaggctggagtgcagtggcgcgatctcggctcactgcaagctccacctcccaggttcacaccattctccttcctcagcctcccgagcagctgggactacaggcacctgccaccacgcccggctaattttttgtatttttagtagagacggggtttcaccgtgttagccaggatggtctcgatctcctgaccttgtgatccacccgcctcggcctcccaaagtgctgggaatacaggcttgagccaccgcgctcggccacgacaattggcaatttctgtcacaaatccttggttagtgttactttgggttttttttcttatttgtagaagtttttttttatatgtaaaggaaattatctctttgcctgctacaggacttacaaatgatttatttcattgtttattcttttgactttgattatggtgttttgtcatgtaactattttgatattttgtacaatttatcaaggttttcttttttttacagtttctaaattttgaatcatatttaggaatgccctctcatgccaaagtctatcatggcttcttctagtactttcacaaggattcagagcttgaaagattcaaccccaaggtcagagacctcttggaaccaaatttcgtatctaaggtgtaggcaatagaagtggcagctggctcactggttactggctgggataattccattatctttggagacttattagaatagtctgactctataatagtattgaatgggactcaaagattaatgccactcgcaggtgcctgcagcatggttacagagcctggatggccatagtacagtaagaatttgcactgagtgagatgcaggtggtgtttctgaaatggaaaagtagccaaatcagaaatttattagtaggaaacacaaaaggaatccaagggatgttcatctgtaaacctgagagaaggtattttaaaactgtcgctgttcacattggcaggtgactactcactctaatagctccttcctgcctctggtgatactaatggacagggcaaagttccccagcataccccattacagcctgcagccacagggagttagcgagggctacacccctttgcctggacatgactaatctcttataaatatcttattgattttggtaggctgctaattatttttcctggaaaaaaagtaatttaaataggatgtgacattgataatgacatagtttgattcaaaacacatttttaaaaatttgatgaatacacacaaagagttgttagtcaaacatctattaaacttagtcaaacatctattaaacttagtcaaacatctattaaacacaatttccaaagccgaattctaatgttgtttatagctctggattgaaatattcagagaattgaatgttcttctggaggtatgcaaatatgttctattataggaacagaaagttaaatgcatagcagttggaaacatcaccttaatttgttccttctaaaaccaatcagaccctgaaaagcattatatcatatactccaagagagtgagatgaatatttgaaaccagagataaacttaatgccacacattaaaatagcacttttcaaaaacagtgagattatctcctttgctcctcatcctcacccagtggggtagatgggacaccaaaaggaggaaactaagtaataatcaacttgcccaggtggctacagagatagtttttggaaaagctacaatacaacctagaattcctgattttcaattctgataagtcatttgacagtagccaaaagttaataagaaaatagtttttaacatgacttacatgggcctttcatttcatgggaaattaaaaccatggtgaatctaaagattttgtccccaagccatgctgagacttacgggttatcatactattggttgataggtctgcttttccttctatggctaagacaactagcactcaccagattattttagtaactggaagaggaagaggggaacacaagtgccatacatgacctcgtgcgactccacaaactctttttaagcttcttggagaaataaacaaggtttgttagttgcagaggtaaaatgtgtcataatcaccaaattgattcctgtagacatcttccgcttgagatgtatgcaaagaatttttgtgaggtacaaattaggtcaaatgtgtcccgtgttttttgttttgttttgtttttttaaaaagcaaaattttaaggactgacacaagggacatacaaaggtttgaacatcaaattttaatcttgaaaccttttatccagtcctcaaattattaacatgaaaaggagtgataaatcgcaattttatcattaccatatcactgtgtaacaagcccttgttacaaaatctccctctactgtctgcaaaaaaccaatagaaaacccatacattatattacctaatgatctattaacagatgaaattttaaccaactttataccaggaaactatgaacagaggtacttcaatcacatagcttaaaatatggagaaaagacaggtaaaaaaattatcttaacctgtagtagtcttttttctttttaaaatttttataaaatacactaatttcccaaaataaagaatattatgacacattggtgtcaacttacacagatgaaagctgatgccagctttttcctaactaaagttcatttcaccaaacctttatatattacatgaatatccaagtaaagtattttttttttaaattcaacacacaggaacataatatacattgtttttttttaaaaaaaaggttaatttaggaatgatttcatcttcaaccacataaagtatctttttaagaccatgaaacctcttgtcattgcaagacttttcagttcatgtttctatttcccagttttaattcttaaaggaaaaaaaaaaagatgaaagggtttattatgtatttcccatgagaaaactgtggtaaggatcttattcattaccaggctgtcttccctccttttgttttccggactacccagatccatgactgcgtggcaccgtaatgaaatcggtgggagaggccaatgacatcaaggaatggatataaaaagacaggctcttctggatcctgccacaattgtaaggtgtgggcaaattcactcccaccaagccttccagagctccacagtcacaggagtagtctcctggttaactcatccttgatgtctgtctgctgggaggacataaaagaccactttcactaatgacttgtgtagtggctaatgcatgccttagccagagagggagcgagtgcactgaagagaccttggtcagtagtggctttggggtagagaagagaacactgtttatttttacacctcctgaattggtcaattctgagtacaaactcatcttaacaggaaatcgcaatgaaatatacacaccatgcacagtctatattactgtgggaatccagtaatacatgcaagacgtggggaaagaatcacaatggatgaatatgaacttttcacagtgtttcttatagcctttgacttaacacgagtgcatcacttaccaccactatctcacaaatgttttacttgtgtcctgggcatgcaggtcagttggggtaaaatgtgaaatgacgcttcatagccattctcagacagtgactacaacttcaatttcccctactttccaaccaaacaattgagctgcttctgctataaaactaaatatatttctaaatacattttgttcaagggttgtgctgtattctttctcattgtttcagtcacttcattctaggaaaattaaaaacccacacaattaaattgaggactaggtcttcagggtgattcctaccaaactagaaagagagggaatcactaacttctcttctctcaagtttctgtctctctaccccaggccctaattgatactgattcatttgtatgtttggtttcccaaagaagaaaaccaaattagagaactgggatttctatcttaaagaagcaaaacataaccccaaaatataatggtagcagggaggaggagaggggaaaatgcattcactctatgtcaaaacgaatctcttgctctcaacaggagataatccagcttctccttacctatcatttcataaattaataatttcttaaaatcataatccaaagaacgtatctattatacgaaaagttcaagtttaaaaaagcaaataaattagttaagccttgtaaacaattgtccattttagtcatatatcttaaaaaaaaaaaaaagtttctctgtgtagtaaatcagacagtacaaggcacaccttatacatccgaatccagactaacaaaacccacacaaacatcttcttcattctgctcgctggggtaactgtgctggggcatcagagtcacataccaatcctttgctcatctcctgaccatctggaagtccacaaatgtgctctttctgttaaactgctttgtgctactttgttgtgtgaagtgattttaagcttcttcagtgtcagtctcctcatatgttttccacaaagcttcctgggaaaaggccagttttcccattacgttgtaatgtgcctttgaaccagccatcctctcgttttttatgaacaaacacaatatctccttctttaagttcaagttctgcctcactctgaggaggataggaaaccaccaccctgtgcctagaaaagaaagagattttggttaaggcgattcaaagcagtgattttaaaaaatggtgtactgttagtctgcacgaaccttcaacataaataggaaataacattaattcatttatgattgtaaaacaactcaaaatactgctattttctgtttagtagagacttagtactaacaaagactggatttggatatgtgtgtcaacccactactgatggcccagactggttcatctgagtgaccttaacaaggacagccatccttgttccctaccagtgtttgtatcttggccataaaggagagtttcatttcatttcccgagaggggtatcatttctatccctccctcttctccaaggaaacaggagtgaatttatttgattggtgagactgggagaagtagctgagcagggggggttcagtcctctctgaaccgcctgcccacaggctaaggaggctctgctccacctctatgttgtaagcacacagaggtcaggaaggtgagtctggaagtctgtctctgtgtccctacgtcccttacactggtgtttgacatgggcgaggcagcaattctgaggaaggtaatctgccccacatacccagattatcccttgggaaggtagtcccaaggtccagacatggaggggagggctatggccacaagttcaatccaacattaccagtaacgaggttgacattctcatctctattattctgacatttgggtctgtttctccttggctcagaatttggagttagtgggaaaggtgtcattatcgcttaaaaatggcagaagcttagttggtttaatattatctgtgcccctgcctccatgctccttagccttcctgtgcagaattacagcttgtaggaaacgagagggaggtgacttgttttacactctatatccttttatctttctctatttttccagcattatttgcattactcctcttctcaacaaaaggggggaaaagaatggtggtgtatggtagccaacctccaagatggccctagtgatccttgcttcctggtattcacactcttgtgtagtctcctcctatgatgcacaggatgacctgtgtggccaataaaatgttgcagaaatgacagtgggtgatttctgaggctagatcataaaaggcattatggcttccactttactttctcttggatcggtcactcaggaaaactggctgccatgttgtgaggacactcaacatctctatggagaggaaacacatggtaaggcactgaggcctctttccaaaagcctaaactaaccagaaaaagtgatgtgaataagccatcttagaaggggatcctccagccccagttgagcatcagctcaggctgatgtcttgactacaatctcaagaaatactctaagccagaaccaaccagatgagctgttccataattatgtgacccacagaaagtgtgaaataatacatgcttattattgttttaagccactgacttttgggcgtaactggttacatggcaacagatatctaataaatacatctttcactgtttgatgctaagtaatgagtagtcagtcataaagttgattttgggtttctactttcatttggttctcaaagtcagaaaatgagtgtatagcctcgtgggacccactcctgactgaaagtgaaaaatattatggcttcaaaatgataggcagaacaaattctatacaactgtccccaaacttctgaaacctattacagcctgcccctttcaccaattcccattccatataaaccaaaatccatttaagaaagaccacagcaagagtcccagactattacactaaaaaaacacatctctgcaaaaggtaagtggctgcttgaacaacctgagctcctttggcacagggaccaaattactacccaagatctgaagcaaaagcacagcacagaagttggcttatcatatctgagaaaggttcagctaattcaaacatgaatattcatagaccacaaggctggggtttgatcaagcatggaatgaggaaggaagcatgacacagcgggagaaacactggcctaaggattgacacagtctttaaggtcagttagagcagcttaactttgggccagttatctcagctctcagtctgtttcctcatctgtagaataggactgtaatgagttaaacaagtatgatgctcttcgtatggtgtctgacaaagagttcaacctgaaaatattagctcccattatgatcatatggcttagacaagagtaggcagaggcctggcacttcaaggaggtgaagaatgggccagtcagtggctggacatctctaactaggaaacgaactcaggccacaactcaggcctcatttcctgaaaatgagatttgacaaactttagatcaacacagttagggttttggaatcccttctttgatatctttattttgagacggtcttactttgttgcccaggctggtgtgcagtgatgcaatcacagctcactgtagccttgacctcccaggcttaactgatcttcctacctcagccttccggctgggactacaggtgtgtgccaccaaacctggttaatctttttactttttgtagggatggcatctcactatattgcccaggctggtcttgaactccttggctcaagcaatcttccagcctcagccccagaaagtgctgggattatagacataagccgctatgcccagctctctgacacctttaaaagcaagacaaataatttcatcatgaatttatctgaaagaaggatccagatgacatttctcaagtctaatgtcaacatgctaaaaatccatgaaaaagcaatgatgtagttgccatgtggggcaagttaaacatttaaggcaaagctttataattctgggaaaaaatgtacaagtgactcaaaacatattcagagtagacttctcatgagatatattccctacttgttctctgtgagctgccttaaaggtgaaatggaataaaaatggttattgaaaaacttgaagtgaattagattaatatatgcattttataaaatgcactaaaccaattttgtcaaaaaaaaattttgaactagaactgctgctgggctaagaacatactcttcctgccaagttcccagtgggagcaaattttcattgctaagttttataaacctctgggggggcgggtggaatgagaaactatgtgcataatggaaactgtgacacagtcttgatcgtatgaagactaccaggtgcaggagtaatagactctacttagaaatcttccagctcaggtcctgatcttgagccttgtgaggtggtttgcagttttctaatacagatttgtaaggccaaatactgggcataactggccaactatttcaggcattgaaaggctttgccaagtagaacatttacagaccaacaaacagatgtaaggcacagctgcagaggccctttacatctgctgctccaccctctgcctcactcggattatgcttttctttatatgaacaggggtttggggaagttctgaacctcaggggtcaatgaatactctcccatgacctacatgggacctgctgatctaccttcaaaatctgcatcccatccactcctcttcattgtcactgtcactatcctggttgatgacttcattaccttccacctcgtcaaatatcttttttttttaagactgagtttcgctcttgtcacccaggctagagtgcaatggcacgatctcagctcaccacaaactccgcctcctgggttcaagcaattttcctgcctcagcctcctgagtagctgggattacaggtgtgtgccatcatgcccgactaatttttgtattttcaatagagacagggtttcaatatattggccaggctggtctctaactcctgacctggtgatccacccaccttggcctccttcaagtctcttcctgtccccaacccagtctatgcagagctcacatactaatattcttaagtggcaactctatttgcagctacccactgccaaaaaatcattaacagctttacaatgcctgtgagcaaggttaatcctcagcctggtatgcgaagcccttggtgatcaggccctaatctctttttacacagctgtagctactactatcaccacaaaagtcccaaacactcccctaagcctgaacatgtcccctattcagggcctttacttcccccacgccacaccttggctcatgcagttccttctagtgggagtctcctttgacgctatctctcccacccataccctatcactctctcaaagcctggctccagttctcccctgtgaaatctccagccccatggctggaggcaatttcatgcttgactaaatcgcagaggcctccatgtatatgtcttacagcacttagcacagtctacaatgtattattaccatctgtgtccgtctcgtttattctaccaaaccataagctgcttgaaggatgagatgatgctaaattcactttatatgcctcataggacttagcatagtacctttaattcttaataagcatgtcaagtggcaaaaagaaaaagcctagttgtatagaaaaactgttttttaaaatgtacaaagctccttaaaaaggaatgaaattctgacacgtgctacaacagggatgaaccttgcaaacgttatgctaagtgaaataagctgcatgcacacagaaggaagactattgcatgattccacttatgagatgcccagaagtcacttacggggagagaaagtagaagggtggttgcagggcctggaggagggggaatgaagagttagtgcttaatgagtacagattcagtttaggatgagaaaaagttctagaaacggatagcagtgaatggttgtatgacaacatgaatgtactcaatgccactgaattgtacacttgaaaaaatagtaaattttcatgtatactttaccacaatttaaaaaataagatatatgaatgaataaaattttttgtttaaaaaaaaggcaaaaaaaaaaaaaaaagaaaggaaaaatgtataaagctgactggcaccttggttggaaagcaccccttgttccctttgaacaaagcgctgtggaggcattatggggtgaccagagtggctcacagaccggtccctgaatggcctctgcctcttggtggctgtgtgaccttaactcaacttttggtgataactgccaaggtacaattcaagaaacagagtcttgcaatataaagaagctccacagacttccaatgctatggtattttaacttccatctgaatgggcatttacaatcttttattagtatacatttcctgtttcctttatttttctagcctctctggtgttctctgtagttcatacattttcatttctaatcgcccctggtatagcccaaattggctcccatgttgctctgggaggcactcagttcatcactctgacctgggtgagtaaccacttactgctttctaccagttgccacagcaatctaatattcaattaagtatttcactggcataaccatactagttccctttgtagcttgctccaagtccaagtaaattacgtccattgcttcacccagtgggttccttgtcactgattcaaagaaattaatcatgctggttaagcccagctgcctttctgtaaatctatctctatccaatttgtatgtttccaagtgttctagcttaatccctgatcaaagatcatacatagatttttttttttcccccaatttaggagatgagcttataggtatgtggttctcagtttaattcctacatttaaaaatacacacagataaagatgacttgctgtgtctccctgaactctttatatatatattttttttctttggaagaaaaacctgtcatatactttcttttatttgccatcccttctgaaatattttctttccactttctctttgcaatttcctaattatttttttctcaatccctctaaaatagagcctaatatatttgttctattgtttctgctgtcatcaattatacattttctgcctccaggatatagcactatttcttgcttgttttcttcagtctctctaacaaacacagaagaatccttttgttcctaagagaattctctctgctgacaccaagacctgtcaacacacttcaaggttcatcctttcttactatgagattgcttaagtctttataccacgtggttgcttctttccattgacagcaccggctgccccagtcacattcttttttttttttttttttttttttgagatggagtctcgctctgtcaggctggatggagtgcagtgatgcgactgtggctcactgcaacctccacctcccgggttcaagcatttctctgcctcagcctcccgagtagctgggattacaggtgcccgccaccgcgcctggctatttttttttttttttttttttttgtatttttagtagagatggggtttcaccatcttggtcaggctggtcttgaactcctgacctcgtgatccacccaccttggcctcccaaagtgctgggattacaggcatgagccaccatgcctggcacattcttttactttagatgtatgagatagggtcatggtttgagaggaaattttatgcttgttctcattataatctgtagatgaatcctacctcatagtgtcccaataatataaattgaaaaatacttctgtgaaattctaccagtcagtagaatttttaccaaaggaaccctgggctccttctgcattttgccagggcaagagttgttgatgcttgtattgtaaatcaaggattattcttagattctgaaatgttttctcaatcatactgatataaaagttaatctttccttcattttcagcattgagcactttttattgtgttgaaatgtttaaaatatgaacacaagtaatccctaaattctatacttggtggcttttaattaatcaaaaactttcattcccagtgaataatataacattttcctatatgttaccgcacatttttcctgttatttttactgtgagacagatctaagaatccaaggtaaataaatactatcaccatcactgtatgaaagcaaaggctgtggaaagttggtcagattggctattatatttaatattccattgaacatatggattataaaaatataaacttgggtagaaatcttctccaaagacccctttcccacttgtaaaaatttaaatggttatacaaaaaaacctatcaaagaattccagcatgcccaggcccatctgtcctgtcattacattctccatgttccctatctgatgtgcatcccccgctccctgaaatgccatcacctgtctgagctagcaattccttcttttcagatgaactgaacagcaggagcctgctgttagaaaggagcccctctaagaggaagggaccggaatgcagaagccgtagagactgaggacatctggcaactgaaaaggaatgcactgggggagggaggctgcagtgcccatgccagtgcctagggagagtctgggcaaagtgaaccatcactcaaaagagtcacacaaataccacaaatgagagggaacacaggagagatgccctcagggcttgaaggaaaactgcagatcaatgcctggagggagggagggaggctttgtgaccaagagaaagcaaacaagtaactggaccaactccagggacagaaggtgctatccctggaaagcagaccaatacagcaggaaaaaggttgactcttagagtaagagattcagtgaattctggacaaaatttcaaagctttactaagagcacaacagatgagaggaaagataaaatgatttcatttgtagggagagaacacttttttagggtaatggctcattttaaaactggttttagggggttagaactatagaaaattattgtacagcactataaaaataaatatcataaattgtggctgggctccatggctcatgcctgtaatcccagcactttgagaggccgaggcaggtgaattgcctgagctcaggagttcgagaccaccctggccaagatggcaaaaccccatctctactgaaaatacaaaaaaattagccgggcgtggtgtgtgcctgcaatcccagctactcagaaagcagaggcaggagaatcacttgaacccgggaaatggaggttgcagtgagccaagattgcaccactgcactccagcctgggcaacagagtgagactcccatctcaaaaaaaaaaaaaaaaaatcataaattgtgagctttgcacttaatgtaagtaggtttgaaatttattcttttccatttttcccagtttatttttaagttaaaaagtgtgccaaaaatatgaatgcaggcctcaggttttggtggatacaaatatacatatggcttcatctgaaatacagaggtaaggtgaatttaaggcatttaaaaacataacactttatagtaagatttcaagtcggcaacatagaaaatgctaccaaaaaagcaatacctccacaaagcagaaatttgctttatttatgaaatgcaggcacagaggaaatgaagcttacagaaacaataaaacagatgacacttaagacaaatactatatatttatataagatataaaaagagtccactattttgagtatacttcatgatgctttcctatgtaatgaatagtgcctcattgttgagtttaaataatcctggtagctatttgtctcattaaataatatattttctttcctaacacattcctagaaccccagtggggtatcaaacagaactgctcccttttgtaataattattcaaggctggaatcactaaaacagggcttattactctgagtgtaactgaatcaagtcacttggtcaggaggagagtcagaactgagactgagaacttagccatacccttctggctcaggaagaagaagagagttcttcgctagacatcgtggctcacgcctgtaatcgcagcattttgggaggctggggcaggagaatggcttgagttcaggagttcaagactagcctgggcaacatgggagaccccgtctttacaaaaaaattagctgggaatggtggcacatgcttgtggtcccagccactcaggaagctgaggtgggaggatcacttgagcccaggatgttgaggcttcagtgagctgtgattgcaccactgcactgaagcctgcgcaacagagcaagaccctgtctcaaaaaaagaagagagttctcttagctgacagaattctctaattcaagcttgtccaacccgtgggcatgcagtgcaacacaaaattcataaactttcttaaaatattgtgaattttttttgcaatttttttttagctcatcagctataattaatgttagtgtgtatatatatgtaatgtaaaatattttttaacagtatatatgtgtgtgtgtatatatatttattattattattattattattttgagatggagtcctgctctgtcacccaggctggagtgcagcggcatgatctccactcactgcaacctctgcctcctgggttcaagcgattctcctgcctcagcttcccaagtagctgggattacagggactcgccaccacgtctatttctttgtattttagtagagacagggttttaccatgttgctgggattacaggcatgagccaccgtgcctggccatatgagtatattttcagtgtggcccaagacaattcttccttcagtgtggcccagggaagccaaaagattggacatacctgctctagttgcttcacaactagcaggaaacgatgtaaatttttaataaaaaaggcaaaaaattaaaaaaaaaaaagacagcaattagtggcaacggaatagaaataagaaagaagtaaatccatgaacagtttcccagtgattgacagtttttacctggacacaattcaggcgtggcagagtagagaaaataaaggaaaaggaaggctggggaccaacccattaagaaacacggaaggaaaaaggaaaacagagtatgtcatgtcaagtgggaaaagaaattcagtgcttattttcataagctcagtttcaaaacatttaggaagatgtggcaaaacatcttaaatatcacaataatgttccagcctaaagcctattgttcattttttagttttttcctggaacgaagttgaacttacctttcacaaacgacaggtctagactcattcaagacaggacccagggaggaacaggcctggcgaggaggtggagcgatgggaactgcggagtccagggaacttgccttcctatgaaaagcatcctgggccagggctgctcctgccactgcagtcgtgaccggtccgtccccgtccacagggcaggagcctgccctgccatggccacctcctggtggcagttcgggccccaccgctccctggagaggaagctctgcactgcccagctccacttctagggtgggcgatgctggaggagacacgcggggcttccgtttagtggaggcgccagaaagcaacttcaacaaaccctttttttctttctggaaaaaaaaaataatgagccttagttggagaatgacagtactattgctggtgtaatctaaagggccctatagttcattactactttttaatttttaattttaatttttgtgggtccatagtaggtatatggggccttatggtttcaatgttcggtttgatctttttacattatttctgttgataactggttattcataatctggccaccaagttttgtgtggtgctaacctgaccttttgcttctcctccttctccctttctgctatatatttttttgtttggttttggacattccgttgaagtaggataaaccgataaaaaagatgtaagacaataaaactcacccaactcacatcccaggtttggtaaaagcattagtagatattttaggataaaatggaaatttcagattatggatttaatttcctgaacttctgcctatcctatctctaattactgtaagagagctgactatgcagaattaaatgtaaacctgacagcactctattccacaggcatggacgtgagccttatcatttacaggcagtgatcagagttaagagctaaaccacttctcacatgtcgccaccttgattaaatgtaacaagccaataaaacagaagtcaaaccacatctcccttgcaagtacctccttgattagacatccattttaaggaaagcttcagtatatttataaacaagttgatttctctttttgcaagcaaatatacaaataagcgtgtttttgtttgtttgtttgtttgttttttcaactatttcaattccacagaagccatctcttgaatttttgtctcttgatactttctctctttggtctgctaggaaaatcagatgtcaagagagtgctccttcattctgaaaccttaagcgtgaatgttctttctgatgaccaagcttaacatgatccttttaaattgttttaccaagatgtcaactacatcattaagttctctgaatggaagcactgcttgaaaatgaaacacttcatagagaactatttctttagaaaattctgtaggcaaattggaattattaaggcccactaacagggaaacagaaattataagggacctgctgaggaatttttcttgggaataatagcttaggctcagtaaaaactccttgggaaaatgaatctaaatccctaacaacattgttccattagagacagtatggcagaaaaaaggagacaaaagcaacatttatcagactatgaggaagcatcccagggacagtgcaccatagtccccagttacctaacgctgctcaaggacatgtgaacctatgggctagaaatgggaagagagggtgggagtgggtgctaaggtcatttctgtacttgcttgacctgggctatagatgagcagagccagctgatccccaccaccctgcaactctcccgggtagaggaagatccttttgcatttctctttatagcctgtcctcagctgatcttatgcgctttcgcttcactcattcaatgccacattttccgtggggctactgtgtgcattctaatgaatgtcctcacaaacttggactgcctgcataagtgcagtggcagtgctgtatatacctctctatctcacccagtgcctagtgcagggccctacacctactaaagcttagaggctgagaaaatactggaagaggatgaaaccagtggaaggaaggaaaaatatagctagtgccaggcctaaggaaataaaggatatgttggattccccagatccagaggcaataaagcctttcaatgagcctttcaataaagcctatagtcaatgaagtggtctgactaaacacctgccactgctgctctgtacttattgtagacagcctgaggtctggaaggccaagagatgacatgcaaaagaataatgtccagtagcttccacttctaaggtagcagtcagctgcaacttccagctattcttgccatgatgtaagaaagcacacactagtccacggacccccaaaggtccagtgagaacatcaagtccattgataaattacaatctcagcaagccacagctaaagctgtttcttaaaagctcagttctgagcactcagtaaaatatcagataactcaacggcactcagggaacagcctctaaagtgattaagaagaaagatgacttaattcatctaaaatgattaaacacattaaatacagcttgctttaatgacttctaagggatgtcttatcatcatcaactgatgctgactacccacagaacagaaggcagaggattaggaatcatggcagggcacaaggggtaaggggtgggaggtggtaatacagaaaagatgctgtcctagttccaaggaaccatgctttcaatggcatattctgattttttctatgttagcagaagaatgttccacttgagagagatcattttgcaaactcagacacttagcatctatgagcaccattattttttcaaaaaccaacagcagaaatgaaaactaaatgaattaataaagactacattcaggctgggcacagtggctcacacctgtaattctagcactttgggaggctgaggcaggaggatcacttgagcccaggagttcaagaccagcctgggcaacatagggaaaccctgtctctacaaaaataaaaaaattagccaggtgtggtggtgcatgcctgtggtcccatctactccggagcctgaggtgggagggagggttgcttgagcctggaggttgaagttgcagtgagctatgaccatgccactgcactccagcctgggtgatagagggataccctgtagcaaaacaaaacaatacaaaaaaaaaaaaaaccacctgggaggaggaagaaaaatcatttgaacaaagaaaatgaacgttagaggccgggcacagtggcttacacctgtaatcccagcactttgggaggccaaggcggcaggattgcttgagcccaggagttgagagcagcctgggcaacatagcaagaccccatctctaccaaaaaaaaattacctaggtatggtggctcatgcctttagtcccagctgggaggatcacttaagaccaggagttcaggctgcagtgaggtatgattgcaccactgcactccagcctgggtgacagagtgagacctcgtttaaaaaaataataataaaataaaagaagaaagaaagaaaatgatcagtagagacttcaagaaaaatgttcagaaaataaaatgaatatttaaaaaccagataggacctctgcttaagaaaatcaagaataataagccaggtgccgtggtgtgaacctgtagtcccaggtgcttgggaggctgaggtggaaggattgcttgagtccaggagttcaaggctagcttgggcaacatgataagaccctatctcttaaaataagcaaataaataaatgaataaaagaacaataggaaaggtcctaaaacactgaagaaaatctgtggttgactccttaagggagagtcattgggaatttgggggcgggggatttgagacactaaatgttgaccttatgtggcccacctgtaggaatgctggcttttaggaatggatctaggatatggcagagtgcatgttgaccaacacccacttctgctgactcatatggaattaatgtcaatgtcaggcgagacttacaaagcacctctagagattctgaagttatgcgtagaaaatggaagcacttgggtcgataccagcatcagaggtggttcctcctctttttctaaagcaagggttagaacttagagaacttaagaacaattacacaattgtactaatcaaaaatttttttttcagaccaggcgcagtggctcatgcctataatcccagcactttgggaggccgaggcagggggatcacttgaggccaggagttcaggaccaccaacatggtgaaaccctgtctctactaaaaacacaaaagttagctgggtatggtggtgcatgcctgtagtcccactacttgggaggctgaggtgggaggattacttgaacccaggaggtagaggctgcagtgagtcgagatcacaccactgcactccaacctgggtgatctagttctgtcacccaggctggagtgcagtggcattaacatagctcactgtagccttgacctcctgggctcaagccatcctcccacctcagcctcccaagtagctaggactacaggcacataccaccatgcccagctaattaaaaataatttttttttttttggtagagatagggttttgctaagttgctgagggtgatcttgtacttctggcctcaagtgatctgcccaccctggtctcccaaacttttgggattataggtgtgagccactgtgcccagccttaatctttttataacaacaaaacacaataaaacatatatacatatacataagtatctcccaaagatttggagacacattttcctggagattagttgatcaaataatgaagactttgaactgaatatgaagttagcagtatgtccagataaagttgttatactgatgacggtggaaaacattagggatctcatagaaggaagaataacaatggtagaaaaggtctaggatttcaaacaggaaagaattgagatgaaacatagagtttcagatgcctgtttatcaaaccacggagtgcagacaccaaagttagctagagattttaacacaaggacaaaaatgcaatgtctagagatccctgagactttgcacaacaggacttccaaataaaatactgttcaaaggagtagccggttagaagagaagctgcgacagtcccatctgtacattacaaaattatatttctctgtggaacagcagcagtaacccactgcagagcagctgggtacagagaaaaggagggggcaatagacacgctatcatgtgggagatgtaccatggactgctggtaggtttaagtaaatggatgatgatgctcacaaaatgacgaggaaagatagaaataatgagggcgttatcaaatacctagatatctgctgtaagtctcaactgaaactaggatctctaatacactttttccttgctgatagtttaatctcacagaaagttgagcaaactgcaactttggatccaattctgatcaactagagggagggcagaaaccagacgggtggagatgctctgctgatgaagcagaaatattgagaacttggaataaagcatggaaaaagaggctgatgatagtcaggtttgaacttcatagtttaaaagaactgatttttaaatgttcaaagaaaatatatgcatgacctgaaacccaaaagggaagatgcttcaagaggaataggaaggctctcaaaaatgaaattctaaccatacaattgcaaatcatccctgcagatgaaaacatagaggcatctaaaggtactgatgtgatctcccagggagcagcctaatggctcaaatttttaaagggcacgtacaaaaagatcaagagaagagcccataacaaagaacataacgtggcccatagcaattcaagaaggcttaaagatcagaatgagcttaaacttgcaaaaatgctaaagacaaaaaaaaattttgtaagagctcttttaaagttatgtttgaaacaagaagaacaagaaagacacagacccgctgtggaggatggtggttcttggatggcaagaagaaagggaaggataatcttcagactggaggggaagaacaaactttgacgagagggaaatgagtgaagagttgggatttagagatcaaatgattactcttaacaggctgaattcactccagggtacagagaaaaatagcagaagaaatgcaaccaataacctttgataatctggtgaatctgggatgagggtcaactgaacaggcaaggaaaggcatgtgcaagtcccagttttcttttttttttcccccctgagacagagtctcactctgttgcccaggctggagtgcagtggtgtgatctcggctcactgcaacctccgactccctggttcaagtgattctccagcttcagcctcctgagtagctgggattacaggcatgtgccaccacacccagctaatttttgtatttttagtagagacagggtttcactatgttggccaggctggtctcaactcctgacctcaggtgatacaccagctttggcctcccaaagtgctgggattacaggtgtaagccaccgcgcccggccccaattttcaaacacatgacaccaaagcactttgcagaccatctgggaaattctaaaacagtattaaacaaaagatttatgaacatttagaaagggaaataaaactcttccaggagacactcgctaacaataagtcacagcagaaatgatggagcaatggggagaactctgtggatgggaggatgatgtaaaaggcaggtgaatctcaatgtggcatctggtgagttctcccaggacatccttgtagatgtgatggagaaatgtatactaaagacactctagtcatgaagattcatgattaagtgacaacaatcatggaattactaaatttatatcaaccagaagtctctttagtggacttggaacactaaatgaggtaggagatttaataagggaaaatttgaaatctgtgatatgaggaataggaaaagaaaacttcaagggtatagcattagagaaaagacacaaggggacacacctgcaaatacctcagggcaccatgtagaaaggagatctgcattttctatgtgggccctcaaaataaagaacaacggttggaaggttgagttgagttacagctgtctgaagatggcacagggcagtcttgggctagggcactgcttggtcaatggggcacgcacctaggcagaagccatggtcatttgtcagggatgggtgctccacaggatgaccagtaaggacctgtactagatggtgccgtaacaggttaactcaaactttgtggtaaaaatcgggtcctaaaatcaaggtgtggcagggctggttccttctggaggccactggggaagaatctgttcccttgtcttttccagattctagaggcttcctgtattccttgacctgtggtctcatttccctatcattcctacctctgcttcaccatcacgtctccttctctggccctaagcttcctgcctcccttttaagaacatccttgagtttacactgggcccacctggataattcaggctaaccaccttgtcaaaaggctattaatttaataaaacctgcaaggtccttttggccatgtaatgaaacatctttaaaagttccagggatcaggaggtggacatccttggggagtcactattctgtctatcacaagtacctttcaagccttagagatttagtgaattctacattggaagggcccagctgaagagtccctgttcttatcagtggcaagggctctgagacacattgtcatcaagccttaaaatctaaaccataaaaataattatttataaatatattaacaaagttgaacatgttggcttgagtgcaagtttaatgtagttaattataaacactgaacaaatatcaatctttttcaaaaactctcatgttaaccgaacaattaaatattaactttttagtaggccataaagtttatttccttataaactgctgtttacaggctcccttaaccatttaaatagaacgacatacattaccacttaaccaggtggctaaaagtctatgatcgccctcaaacttcccagaactggtatagaacttcaggggaaatgtgtaaaatattgaggaaaaagtaataatgacaataaaattatccagatccgttaccatctcttctttttctttttacatttaacaactctcaatttctcttgcctccaatcacctgtctctaaacccaaccatcggttattctttccaatataactttccatttatattttctttaaaattcagccccaaatgagacattaaaaaaaaccccaaaaactatggatttagaaaataatgtttccttatatttcaagtcttacctctcaaggaaccatgctgcttaaggtcagatgtactgggccatggaccagtactagcctgtggcctgtgaggaaccaggccgcacagcaggaggtgagctgcaggtgagtgagtgaggcttcatctgtatttacagccgctccccatcacttgcattactgcctgagctccgcctcctgtcagatcagcaggggcattagattctcataggagcatgaaccctattgtgaactgcacatgcgagggatgtaggttgcacactccttatgagaatctaatgcctgaggatctgtcactgtctgccatcatgcccaggtgggaccatctagttgcaagaaaacaaactcagggctcccactaattctacattatggtgagttctataatgatttcattatatagtacactgtaataataatagaaataaagtgcacagttaatgtaatgagcttgaatcattctgaaaccatttccccgccaccacccctgggtccatggaaaatctgtcttcaacgaaactggtccatggtgcccaggtgcccagaaggttggggaccactgttgtagataaaataaatccataagtaacacttttgatcaacagtttcatccccctcacacatatatatttttaacagaactcttatcaagcaagactcactgagcaggaagacttgaggacagcaaaatgatgaaagaatgagtaactaaagggaaaaggaaattcctccacgagactgtaagctgcacaaggaggagtgactaagtctcattcactgtggtccctctaacatgcagcactgagtctggcaagtagtgggcgtttaaacacagagaaacatgagctctagataagaggatggggtggtgcctgcgtttcttccccactctactcctagcacctggcatagtgactcacacgtagggagcacctgagggtttgttgaacagtgagtcctctcattagctaaaaatgacagacacaacataagaagaaaaacagggaagtaagtaaagcagagaaacagtaagtaagtatggtcttactttgctatccttgtctggtttggttgctgaactgttcccacaagctgatgaagcactgtcaggagatgtggggagtccagggagaacggtcactatccggccactgggctcagcctccagagaagcactggtgatgcttggggaagtcagtggagcagctgctgcacaggccagaggggcactggctcgactgatactgatggcagcagtgtgcgtggctgagcctggcatcagaggcgcaggttgtggggaggccagcgagtgatgggacaggcccacagatgcagggctgaggccggcggcattctgtacctggatgggtgtcactgctgccgtggggcgttcctggttgtgcgctgcaactagtagatgggaagagggaacacagcaaaattcaactatctaatagatgctgctcaccaaaacatgagtcatttcactgcatcagaccatgatgaaaggctgctattgtatttattacaataaagatgggatggacggtggcctaaaagcacttaatcttagctggatccccagacactatctattgtccttccaggtcagcccttgagtctactgagtgcctggaagctcagttttgacccaagtccctttacttaggagacagcctctccacagtgttagagacactgagccagttcttgatggtattctacagtgtcaagcgatgtctccctctagtccttttcctattattcattcccttttcttatgaatcattttccttttttctgtttttctgatagagttcacaagcctttagtttacccctcatcccattagttacccaagactcttgggaaggttttcagtgctacagaactaagaaagctgtttaagatcccatagggtccaaggtagacttgtgcttaagttaatcagaaatgatcagcacacccgttagtagagtatcacgcaatgtcacatggatggtagtagtgagatttgagatcatatgatctcaactatagaagtcaaaatttcaagtactattgacattcttaggatcagcctaatttctttcagactttagatctatccatcaggcttgaagtaatacgcagggcacgcttagcccaaataagcagatacaaggtgccactgagtagactttgcctaatgttgttcattattaaaattacatctacatttctcaacatctgtcataaaagatctactattaggcaggtaagccctttatcctgatatgttctggcctgggttcctccttacctgtcctcacagcattgcgggcctggttgactgtcatttgccccgtcatgtgcaacaagaccttagcctgaggacttgtctggatgtgagctgctgataccacagctgcggggacaacactgggactcccagccacgccatttccctggagcttctgggcaggccctcctgccgtggaaggactgaccatggtcactccccgacttgtctggccagctgtagacatagggactttagcttgggaagcatttgtcaccgccctgccaagacacaaacatagatggaaagcccagtccatcagcaaaatgacagaaagaacaattaaatgcaagaaaaatgactcagagctttaaacatagaacattttaaaaaatgaatggaattatttttataaagtttaagaatagaaaattcaacgtaatgatggctgagacagagaaaggtcttgaaatatattctgagtcaccagaaaccacacgtcatactctgctcaagaatatacagttattgcattcagctttccataacaagaccaaatatctccactgactttcaaggccctggattctcccccttcatctacagaacaagctaggatcattccctgacaatatccccatttccatatctttgctcctgtttcctggcttcctacttgcctccagctccacatcacacatgtgcccatgtacatgcatgcacacacatacacgcactagtggaaagtcctctccgtcttctcttgacatattgtaatctcatttatgtttcaagatccagcatgaacactgtcagttcaagaagccttgcctcagattcaggtttaagatcttatgattctattgtttcatgtggatttcttctttcattctgtttctaaactccacaattgtttatgctttggcccttgattacaaaatgtggtatattattattagtagtagtagtattttttttgagacagagtctcactgttgcccaggctggagtggagtggtgcgatctcagctcacccctctgcctctcaggttcaagtgattctcctgtctaagcctcccgagtagctgggagtacaggcacgcgccaccatgcccggctacttttttgtatttttagtagaggtggggtttcaccatgttggccaggctggtctcgaactcctgacctcaggtgatccacccgcctcagcctcccaaagtgctgggattacaggtttgagccaacgcgcctagctggtgtattattttttaaataaattctttatcaaatactgctgacttggtaagttccttgaaagcagggccagtgtgaaataactctcctgtattcatcctgtatttgcacatgctcagggttacagccaactctaaacatctatttactcactgaatgtaattaagttcagtatagttttgtgtaatgtgtttttttccatattccaaattcatttaaatgataacaattctgtatatagtaactttctactaagaaaacacttcattagcttgaacatccttattatttaccatgaatgacagaatttactgtaagcacatattcctctagagttaaacaaacagatagattttttttttccttaggatggagtcttgctctgccgcccaggctggagtgcagtggcatgatctcggctcactgcagcctccgcctcccaggttcaagtgattatcctgcctcaacctccaaagtagctgggtctacaggcacgtgccaccatgcctggctaatttttgtattttttttttttttttttttttttttagtagagatggggtttcaccatgttggtcaggcctcaagtgatcaactcctgacctcaagtgatctgcccaccttggcctcctgaagtgctgggattacaggcgtgagccactgcacccggctatacaagcagagagacttctaataattggtttttgataaagatgtttgacaaaaaaatttttataaaaatgttttccttcattaactttatttttttgttctttgttgcatttctcttatccattattatcattattttgcaccagggaggttctatctgtcattttctggatgggatggattctgaatgtagattttaacatacatagaaaagaatgtttatattgattaaaaatttgcaagtcaaattaaagttaacattctgtcaccatctgcaacaacagtgattttcatttgattaggctgctggccaacctataaatcaaggccaacagctgacaaacatgtcagttcattaagctatttgtttaaaatcaggcggtttgaggaaagatttaatgcagttagacctggactgtatattaaacggccggtggtcaaaaactagggctccctcagtgttgatttcattacaggtcatttaactgtttccaaggcttctttcctcagtgaccaaaagctgaactatctttacataaaatatataaaattttgcatatctaaagctcctgtcactctataacagggtttctcaacctcagtgacattttaggccagattatgattattttttgtgggaggctgtcctatgcataggatgtttcactcttagcctctatccactaaagccagtagcacccctaacctctagtcgtgacaatcaaaaatatttctggatattgtcaaatgttccctggggagcaaaactgccctcagttgagaaggatctatgctatacttaaaatttttatttctgactatattatagaattcattgtcagaattcagaggtaattaccaagttaatgaaataaatataaatctagatcaccagggtttgagtttgagcacttcttcactatgtgatctcagacaagctgtatgatatctctgtgcctcaatgtaacagcaactaagaagtaaggttaatcagtgtaatgcatttataaatctgcctgcctggcatatagtacgcattatataaacacataagtattaataatatagcttttctttgtatcaacactatgccttttctagtagaaaaatactgaaaatggtgttgttgaaccttctcccattaaagcaaataacttaaaacccagtacatttactggtagaaacctataatttcacatatatccatgtgaaaataagctaaaaattttagagttagaagggattttagcagatgtagacatggatttttaaaaccttggctatgtaacaggcaattataatgtgaaaggaatctggataggctgaaaaccatggaaaagaacaaagcttctctgtttagaacatagtaaacaatgtattcaaaaccataccttgtgactggtgccacataattgccagggaaaacccctatcttgctggtatgcatggatgtccctttgaaccagccatcctggcagcgctcaaacactaaaaacatctccccttttctcagctctagttcatcctctttccgaggagtgtatggatatatagcaacatacctagaatagaaaataatatttgatttcaggttgagtaacagacaaatcccaagatgctcaaaattcttccttggtacaaagtgttgaacattttgtacaaatgtaaactgaaagtataatcctttaatctataagtagcactgacaattctccattgaaagaggttttgctgtctacattttaaaagtaggcagaggccctcctgattaagaacctgttcctcccagtatggaagttactatcccaccaaatagtatttgcatagtgtgaaagaattaatgcagtttccaagagtgcctaacttgctaccagagattatgtacccactgggaaaactgagttcttcaaatggcacttgttaggcttgagaagtagccccaaatgagaacatatggtatgaaatcccactgggaagcacaacacgctggcttctacacacaagctgaacctagaggcttgagctacacctgctttttatgctcagttctagggaaaaagactgaatttgaaaaaatcaagggagaacaaagtccagatcacaaaacgtacaagacaaccccaagatgcaaggtgactgtgcccacgaacacatggtaaccaggcaggcaacattaacctatagttcttaccagtgctctaaacagttggtgtataaaattacacaatgcaggatccacgaagacctggctgtattctgccataaataaactctcaacaggataaacttttctggatactcattgctgaggacttaagctttttacattcacactgcaactagacctagatatgatttgtgaagaatacctttctgtcactagtattcttatgcaagaaatgaaaataaagataaaaagttcaaacaggagttgtacaaaagaggcagtttcatacccatataatattctggcaagctcatgtatcagactgattttctttcagcagttccctagttacatgcatgaccaggtagaagtttgcaggacacagaccgcttggtgagccataacgctgtcatcagctcatgtcagaaaggtgtttcttgacctctgaggtttggacttcgtttaaatgaacacataagcagtaacagacgacacgctcacttacacactggggcgagtctgcggccgtaaatgtgcaatctggtcagtggatcctgccatgggcctcggtcccattccagcagcagcagcagcggcggtggcgcctggtggtgtggaggcaaggacagtggcagccaggagagggggtggtggaagaggaggattcaaagtctagtataggaaaaacataaagagaaagggaaaaaagggaacaaaatactgatttacatcttcctatggaaggtgggagagaaaaagaattataaatccatagaacaagactttaatggaatccacacagggcagaatcagcaggctaactgatatgaaagcctgcttctacaaattcatctcttgttctcctttaaaatattaaagccaaagcaaccttttcagcaagcaggtaagtaatcacccttgggaggagggaaagaaaaaaaatgaaacaattgcatgtaatcttaagattaatagcattttaaagtatggacttggacaaggatccaaatgcctttcgaggcgggtagccatgtcatgctgcttgctaggaattaatttgtgattgtttctgtaatctgaaacttaaacacaacacacaatgtagctgtactatatctcaaatcattccttcagaagaaaatttcctttgatgcctggtctacaaaaagcccaaacaatagtaagccacagtcactggaccattgttgctacttttgcttattcttttcttaactttgccagcttttgaaatttggtactatcgaggctggtaatctttaacaagtacaccagtgaaaagctgctggttcctttatgggcacagcctaatggggttctgcctacaggattccatgccttttgaaaatcaatggagcaattgttaccttctgatctataaacccagataattctttagggtctgtatactgaaactcttgggaaaacaggcacacaaagactgcctgaaccgctacctcgtcctctccagatctttgaacaactagatgtaaaaactaagtcaaaggagaaataagaagactaaagaatttacctagttaagtgtaaatggcttctatatgtcagcatattaacaaaataaagatccaatgatttctaaacagagcttataccagtcatcttatttctgttttttggaataaaaatttgaatttcatcaccattcactataatacatctggctgttaatatagacatacatagttccagaaacataacgaactgagtggaaaaaaatttcaaatttctagacgcacgctgtaactattcgatgcattatgtttaattttttgctaaagcgactttcaataaagatttttcccacactgtagctaaagtggttgcagaacatttagtgcagaaacaaatgaggtgcagagccacttacaaagtgcaaaccaggagaaggcagaggttagctcaaaaagttggaacgtcaggaaaatgtggctcacattctcaattcaaaatatggcaccattaagatttgttatagctcgcaggcgcagtggctcacgcctgtaatcccagcactttgggaggctgaggcgggcggatcacgaggtcaggagatcgagaccattttggctaacacggtgaaaccccatctctactaaaaatacaaaaaaattagccgggtgtgatggcgggtgccagtagtcccagctactcgggaggctgaggcaggagaatggcgtgaacccgggaggcggagcttgcagtgagccaagattgcgccactgcactccaacctgggtgacagagcaagactccgtctcaaaaaaaaaaaaaattgttatagctctggaatttgcatgtactgaggcttagagcctccaaaacctttaaccaggagaagggcaagcatttatcctgttaggcttctttccagtgacaaagcagagataaagataatcctggtcacagcaaatgtgacctggacagttcatggataataatgcatcagcagtttgacaggtgagataatcggtctacactgtatatagagtaatatatggagaaactgtaaaattaccacttcactgatttccatttaaatctttctaagctcaatctcaaaacagtgtggctgtggaaaggcagaaaactaatggcatgtgctcaaacagaaattaaaatcatctattatagcttaactttattaaaacagaggctgtactaatttgacctaaaaagaaaaggacaaaaatcatctatgcacctgataaaaacatgtcatcttttgtaatataaataaaattttgtaataaaatataaaatcacttcttgtcacaaaatacactaagttaaatgtttcatgtacattacttttgcaaacagtgagagttagacattaagatatggcatcaaagaggatattctgaaagatcccaaaggttcttcctgacagaaaagagttctctctcactttctgtggctgaaacataaatggtttaatacaattgggcagatcttttcccagtgcatgcatgtttgcatgtgtaaatttgtgtgtatgtgagcaaacagatgaagatcaagaaactctgattaaaatcagattcctagatgttgcttgcccctgtggggttggtgaaatgatagggttctggtgactccagagctgtgacagactaggaaattttgtgggttgctttataaacaacctaaaccaaaataatctggtgatgtggaagttcaaaaggtaatccactgtgtattgtgcttcaggcagtttgctgtcctgcaagacctgaaatttccacagagtaaaaccacacgtagcctttcattcacccggaggtgacctggagtcctgcttattatttcatagtccaggccagcccaggcaccagaggccaagtatacactctctactacaggcaaaaaacagctatggaccttctagaaaatgacacaaaattcacattttgttaacaatattctgctcaccaaaactaggacttaagaatggtgtgctaatgggaaatggtcatattttgccatgtccaggttctcttctcctgacccagtgatcttgaaagaagagacagtgttacatcactgaaggagcatggcctttggggtcaaaaaaaaacatagattccaaccctggctcagcctcttggggcagtcctcgacttccttcccttgctagagtgagcacccagggaagaagtgtcttctctctgagtgggcagcatttcagaacactggcaggtgacaatgctagtgacactgtgagtgaaaagttcaagtatatgggtgtgaaacttctcccttctggcactctcccctctgcttgccctttcatgcaacccgcccaggtagtgattggatcttaggatctggctaaagagaggggaagtagtccagtacgtctcaaacttgggccaagggctacaggccagcttgccagtaaagtgctttgcattggagctttggacacaagttcaactgaaaataaagggttcatttcctttctaattgtctcttacgtgtgtatctccctcacacactcccagggtagaaaagtgactggcaagatagactaagcctttctgggtcccttgggcaaatattattaatattctctaatctaccactatttctttctaaatgtctgatttccattcagcccactttcaaccctacatatcaacatgtctgaacagtccttgtgtgtactgaactcagatgcatgaatactggttgatgagggaatggttcaagctactacatggagatgcctgttgaaattggtcaacagtgttaccaagttcagcagcattaccatctacatgcataaattataaattttttgttccacatttgatctacaagaaacaagagagatatgtatatcagttaagtgactctgtaaattccataaggtctctatgtttcactataccaacctgagagatggagttaataattagaaatagtttatgtaaattgtctttcccagtgccctggaacacagcagaagctcaataaatagaagctattgttatgattaatgagattgtgaagtcagggactgtctcacccgtctttgtattggtggcacctagctttgcagctagaagataacagatcctcaatgagcatttcatgaatgaaaatacactatgtgcttctatccccttcttagaacaatatggtatggaataagaggtctcagttcccgagatgctagaatcctttcctgttgctgctatgaaagttctgaccatatcctactcttcaccctgatttttagatctcctgccaattccaaaggctctacttctaactttcaaactagcaaggttggcagcctcatcctctacttccaattccctgaacccaccaacaacagtaagttctgcttagcctccaccatggctacatattggctattctgagaatctgacattcaactttgtttaaatacacacatacaaacatgtatgtgtataaaatttttattatttttatttttgttttttttaggaacagcatctagtcctggctggagtgcagtggcacaatcatggtttactgcagtctcaacctcctgggctcaagtgatcctcctgcctcagcctcccgagtagctgggactacaggcatgcaccaccatgcccagctaattaaaaaaaaattttttttttgtagagacagggtctttctatgttgcccatgctggtctcgaactcctggcctcaagtgatcctcctacctcaggctcccaaagtgctgggattataggcatgggccatcacacccagactaaaattttaaaatttggaatgcaatctgtttataaattggccatgagtggtatttacctttattgacctgactaccttataataccttgcagttaaccacctcttggctggtccagaggatcggggattattcatcacttgttttaaaaggccttctgccattatgcagaagatacgagactaagatcttcaacctcctcccctacaaagagatttttaaaaaatcactactattaatagtttgatgtctgaattagatacatgtaataccagtattgctcataatgttggatatttaaaattttaactgttacatgtgaaatgtatgggacaatgtttataacttcgttctgcataaaagatttaaaaatctcaattcatgaaaaaaagcattggaaataattttcattttttattctactggtggcatttattgcctataaatctataccatgaaaagcctgccttcttttctaccaagctgtgtgccattgctgttaatagtactcacagtcttcggaaccaattcaaattttaaatagaatgcttgacacaattaatataagatgcagagggctcctgctactgagattttccacttaaacctgacatattaaatctaaaacatttctgccaacctaccaggcactctgagatctagacatctcctgggatgacagacaggtttgtttataattagtttttcattaaatgaaattggcacagtagacatactgtttaatcaaccttcctcttgcttaacatgcaggttttcttatataatcctaaaataaaatggctgaatgtaaattaatttttgtatatccatgttctcttgtgacctgtcccattgatttgcctcagagtgagcctccaggtaagagtaactggccatttactacattgtataattttcagcccacaagagctaaaattaagccagccttatgtcttttcccactacaggttgaatatcccttatccaaatgcttgtgaccagaagtgtttcggattttgaatttttttagattttaaaatatttacttcaccagttaagcatcccaaatccaaaaatctgaaatccgaaatgctccaatgagcacttcctttgagcttcatgtttgcactcaaaatgtttcagatttgggagcattttggatttcagatttgagatgcttaacctataattaaattttctattatctgaaaagttaagtccttttctttcccttaagaaatcaagttagaattttatcatgcaaggcactcatctggaaatgaaaatatcaactcattgtgtatgtgtactgtgagtgggaaggaaaggagagagtctcccctggagatgagaggtcatgatggttaaggaagttggctctggtcaaatatccagggctaatagaatctcagggaaaccaaatttcactaaaagttaactgaaattcatcttctccccagatgaatccaggcatcttctccttcgccaagcagctgtactatcaagaaagttgtaactgttcaggaaacattaaaaacgaaaataaaacaaacaaacaaaaaacacctttaacctctagctacaacattattagcttccatttaaatacaagaacatgcttaactctaaaatgttttcaaaagcctaagtcaagctaggtaataactctacatttatttatatcccaccttgtttctaaatcagttttcaattatttatagatgtatcaagacaaaataaataacaaataggaaaaacaaggcaaatggaaaataagaacaataaaactagccggagccaacattttgactaattatgttgtggagtctttgctggaggggctacaaatctggtcctaagcactctagcagagggaaataaaatctttacaacatgtataaaacccacaacctaaaaacaaaccagctgcttagaagcctccctattcctggtacagacagcaaagaaaactgtaacaaagtaaaccaggcccaacttgcaacagccctcaaccgagcccaaaaaggagatcaataatgttcatccctttctatgatctaactctgtgaagtagatacttattttatggctagggttactgaggcttaaagaggcagagtaccttttccatggtcatataacaaataaatggcagagctgggcttcaaaccctgactgtttcaccacaggcctgcacccccatcatcaggacacaccaatggcattctctgcaaacagcacaacttacgactgtgggcaggcagggtgatgcaattggtgtaggtactagggcaatctaatttaatgatcttttctatcgtaattcaactcagcactggagcaaatagaaaatataagccaaagctttggcctggatgagagatgtctcacaactgctagttccttgcttataattttatgaaacaaggtcttaaacaacagtctttctctactaccgaaggttgcatttgcttgttgcttcccttttaattttctttccagaatggccctcttctttgtatctgtatctcctggctaccctaattctccctattattttcccatttggatgtttttaagcaattagccgtttagactctatctgtaggatgtcatgttttcagaagggaaatcaacataatctaagggggccttccaagactgaaggtgcctttaaacagccacagctacagaccatatggacacaagacaagaaattaaataatgaatctttaatgtagagatttggtatcggatctgtcatgtgactcaaagtaaaccattcaccttcaggacctgcttccttagtattttcataaatgtgtccttataagaaataagcaggatctagaaactcaaaagaaataaaggttaagcttcagaaaatcaggttgaactttaatgaaaattaaatgtatttttgagttcttctaatagcttcaggccactgatcctcactgttaaaaattttgcaggatgcaggcaagggactttctaatgttttgttaagattaacagagataatagatgaaagatagatacccacctcacctaacaagtatgaacatacgctgcaggtgttaggaggtggagtgtgccagattaacatgactaaagacctaaaagagaaataaaaatgggagaaactatactcactccaagggcagcttggtagggaacatctgatgggaaagtaaacgaggggccagttgtcactgggctgcttgggggcggggtcacaattaacccggtggtacttatatgaacctgccgagaaaagaaaagttattaaaaagaagactatgtttaatacaacagaatatactggctaaaccttagaaaggcaagtcacattaaaaaaaaaaatctgtactttctgttatttggggaaggtagaatcccttttagtctgctcaacccaaatttaccagtgacctaatttgaaccaggcattttactagatgctggggagtgatgtgataaatactggtcacaacagtgtcttacctacagaattcaactgccattggctttcacggtaacacattgcctcatttggtacgccaccatgaatcaaactggccttccaatggacagcctggtgctcaactagcctcctaacaatttccctgaagatcctgttaaggtgggtagtggctgaacactcacctgtctatcaatacgttaaatctatgtgaaattcttcaggtattttgctattttcaggatcatttttcatgacttctacctttcggtggggatgcataattaaaatgcagctgcctagacatgcttagagcgggcaattacttataaaatctttaaaggaacaatgtcaagccaaattagttgttttcaaaggtgtcttatccatgatacaacccaagattaatttactagaaagaaattgagttattcaggtcatttcattgcctgtgttaagttactcgatcaatttcactcaggttgcatagcaggtccaactgcagaatgcagtggtgttactagaagctacagaagtagggggatgggttcctgcacaaatggaagtgtttcttcccctccagtgtgaatagaagcaatgtggttggctggtacctgcctccctaagaaaacaataacccacccaaaatgctaggttttataataaaaatgtaatcccaaacatagttttctcagttcccacacattgaaagaaagattgtcaggacaaagaaaagctcagaggttagttcccagaggacctaatggaaactttcagtttcccactggggtaggcccgaccaaagccaggcataatcagcatcatggcatgtaatttattttcacaaataaatctatgctatacatggaatctgcaatcttttaaaattcatctgtatctattagtctatatattgattgaactaaagtttgaaactaagtagatccagggggtggcactaaaaagagtttctccccaaacccagtttcttccttttcttcttctcctcattattttttattagacagggactcactatgtcacacttcttattagacagagtctcactatgttgagcaggctggtcttgaactccaaaccctcattttctatttttcctgtgaaccaaagtctatttccaacctatttctaacgggaagcacactggtttcaaagtggacatgaggcaggagaatagggtctgaaggcagggaacctaaggctgtttcacgctgacttcccagaactaaactgaaaagaaaaccttaactttccacgcctaagtaacaaatggaccaaaggcaactttgcaaacccccaccttttctgaaccgcaggtgggaaactgaaagtacctctgactggttgctttctgtaaccaatcagccatttgcataggagtataactttgtaacttcacttcagcctctgattggttgctgtcctcaaccattgattgtgggccaagtctttgtttgcatagaagtgcaactctgttaacttcactttagcctctgattggttgctttccccaactactgattgtgggccagcacttcatttacaggtggtgaataccaagtgtccaatgggaaacctctagagggtatttgggcctgagaagactcggtatccagggcccttgagccgctgctcgggctgctcccacactggcgtgtactttcatttttaacaaatctctgcttttgttgcttcattctttccttgctttgtgtgttttgtccaattctttgttcaaaacgcgaagtacatggacaccctccactggtaacagacattattatcaaggaacccttggggcagaaaaaaacttaccaaaatacaacttcctgggcctgaccctatacatatctgagaaagatatcattattgattgacatttctctaaaagcccagagtgggagacagaataattagctgttaatgacctcatggttttgggataagtcccttcatgtctctaggcccctgtgagcaggtggaccagaggctacctaaggtgtctgccatcacaggcacttcagggaagcactgacatggagaatcctgcaagtaccccttcaatacagggctttcctagcactgcagcaaaggaagagacaaagtcaccaaagaatgactaaacgcagaaggacaaaaagtagaagtaaaccagtctgaagggtgagtatgtctagaataaatgccctgaatagggacaacctgagtttctgctgggcttacccttttctcatggaactgcaaaaattagttgtctcctctgcaagaaaggctaagtaaggtggggaagagttggggtaagcaaaaaggaggtgggggtgggggtttattgctttccctgaggccactgaatacaaagatgccatagaaacactgaatattatgaatcactcctctggaggccaaaaaatatcctaagtgtggtcagaggaggagacaaaacatcttggctgcttgtaccaccatgtgcttttacagacactcatgtcacagtcacagacactcatgaacatctatctgatctggcgacccacctggaaagcactgcctataagtaatctttcaatttatgtatttgaaagttcagccatcactcaatagtcactaaatataatagcaagcaagccctttggcttccaacttgtccctttcaccttccagctgccagcaatttggacgtgacagtgacatctctaattgccatatagaaaccagggcataaggacccacttatatggtgtagacatgagctggaaggtgccgaggtccctaataactttgtggtgctattatgccagcatccaactgcctatatctagatttcattgggatgagataaaaatgaatactaacatttttaagccccttactttcaattttctaatcaattcagccaaacttaatcctaactatactaaaaaactacaaaaattagacgggtgtggtggcacacacctgtaatcccagctactcaggaggctgaggcaggagaattgcttgaacctgggaggcgaaggttgcagtgagccaagattgtgccactgcactccagcctgggagacaacagcaaaactccatctcaaaaaaagaaaaaaaaaagaggctgtgcgtggtggctcacacctgtaatcccagcacttggggaggctgaagtaggtggatcacctgaggtcaggagttcgagaccagcctggccaacatggtgaaaccccatctctactaaaaatataaaaactagccgggtgtggtggtggcgcctgtaatcccagctacttgggaggctgaggcaggagaattgcttgaacccaggagacggaggttgcagtgagcagacagtgccactgcactctagccttggtgacagagtgagactccatctcaaaaaaaaagaaaagaaaaggaaaggaaattgtaggcaaaggttaacatgtgtaaggaaaaggaagacagcaatcaggtcaatagcagggaacagatttagcaatgggtctcagttaaatctacagccaggctctttgctgggcaggggaaaaggagagtcctgttttaaatggtcttacatgagccatttccccatacgcactgatctccatggttggaagagtttttgcacgtcacaaatgctacacatgctcaatgctctattgtggcctggggtgccctccaatgtacacagtgccctagataagtagtgttttctgtaaacctcggctggagaaaccaggcagcacttcaaacacctcccagcctcttctagaaataacttctccctgaggcaacactctgccactgaaaacagaacaaactggaatatggaaggaggggtggaatggttgaaggggaaacttttaatggaacacagaaagagccttgtttcctaagctacttgaaccaaaacaaaaatagctctacttttatagtcttcattcccagctctggtgtggtaacgtcaggcatgctcacacctgaatgctgagctctctgcaaaagatgaaaatgctcagtatatcttcttttctcttttcattttctctaatgccaaaagattattgtccactctcttaaagctattcccattctgagctgtcactattcttggcagaagcttgtcttttatttcaagacaacatcattgtgcaaatgttgctaggtcccaagataaaaagcacagaatcaaaatgattccattttctgttagtgagtggccatcttcactagctccctccttcagaaccttactcaaaaatctttagttctgaacctttctggattaacctcactttgcccttcctactctgatctatgatccatgtctttttctcacacggatatgattagttaaatgtaaaatgacatggttcccctctctacccatttttcaagtgactcattcatccaacaaatacatgttgagtgctttctgcatgtcttatgtctgccacttagaatataatcagtgtacaaaacaaagacccttgccttcactgcactcatgttctagttgtgcgttgtgcgtgtctttatttctcaataagagtttcatggccctaccacctaaaaatgccacaaaacaacaatcccacaatcccattcagaaagtgaatgcatttaacttgaaacacgcagtataaatctaaaggagcagggtcaaataaatgaggctgaggctgtggctcatacttgtaatcccaccactttgggaggcccaggtaggatgttcacttgaggccaagagcttgttaccagcctgggcaacaaggtgagaccccatctctattaaaaacaaacaaacaaacaaacatgaggctgagaaaaaaatggcaagggatatcaaaaactgtattttacattttcattctgtggtccaaaataggcacttactagaatgtaaactttttgaggaccaggactggtatttctttctttttctttaaggggacataatttcattttaatgtttaaagaaaaaaaaaccaccatagctatatggtggagcagaatgtaaaatctgcatgaattttcaagatgaaacatgagacttgaaagaaattccttctgcttgtgacaggcagctttgaactagattctttgacctttaagttgaacaaaatacagccatcacctaagtggataatgatagcagccccgtggcttgggcagggttataattaggttctttttgtagtgcagaattaaagcctaacacagcaaattgctatattttagatatcatggtatacacagtgcctagaagggtctaatagtaaagtgctcaataaatgtctgccaaatgaatgaatgaatgattgaatgaatgccccagtcatcccatgtatttttataaacctaagaataacgcgtggctattttttacataccagtccaaagttgtaatgaactaatgaacttagaaagtgtgaggtcaatttctaatttaaattaaatgcttctttctgtccttgctctttttctcttctctataattctgggaagcctacatattaaggtaagttacatagatacaagcaactacaaacgtcacgagtttggaccatggcatcttaaatctgggtggagataaagttttagttggcaagatctcccaaagcagtactgtgagaaagttctgtaaggctgagtgattgcttggtgaaactggtaagtattatataactcatcttgtaagttctgatctttcctttgaaaatgacagagtagttagttctgggttgatacactcaagttagctttcccttctccatttttccacttacaaaatgaagacaggttttgcttcccagaaaagttactatcttcagaagttcaaaataagcaatgtttgtcagccagtgagcaaacatgtttgtaagttgatccttttgtgggtgagctctttttatataacacttgtttgaggatttacctgagaaggggcactgcaggagagcccagacagctcgctgatccgtgcagcagcagtggggttgctggagctgatgaggacaggggggctgatctccatggagtggcggttctgggatgcctgggaggacttgttggccatagtgagggaagtgaaggagtgccgctttttggtgttcttcttggtgtcggagtgctttggggcagtgctgctctgggctgctgccgaggaacattctccagcatcaactcctggcacaggaggcttatcccattctatcagctgcttagcagccgagttaaactgcaaaagcaaccaacaaaccaacacaagaaggttaaacaattcctaagaattccctgaggtttatttccaacatgatttcatccaaaatttaaagtcactactttaaagtttgcctatgcagtgtctgtttttcccatgtgagatatctcttctctcaatattgggacttcattgtatctatatcacaggtagatattaaatcaagaataaacaattccattgcaagactgaaagagtaaaagacaattttcttaagaatttccataatgtctgattttaaaacttgccaataacaaatgaaaatttatttcagctcactgtgaaatttcgagaagagcaatcaaaatggtgtatttatcacccttttcgtgacaccctgttgcacaataatggttgggtatttgctcaaagcacaactgaacaatgaaggggcaacttctgggtttggtaaaaatgagcaagaagacaaagaataaaaccattcaaaatgaactcatgtgcttccatgtatatttacctcctgcctttctttctgtattctgggagaacctcacaaaaagctggcagaaactcttaatatgttttttgtcatgtcattgtatcagctatcatcctatgtgcacgtactttaaatcataacagggtaagacatgaaattcaagtcctattggcaagttaacttcatctatctgaaaagccccagtgtaaattaagagtaccaggggtcaaaatctgtgcactccactgatattatcagcaagaaaggaaagaacacaagccttttgttttccctagggtaaaataaaacatttctggaaagcttcagtgacaataagctgcatataactttcccagatattacagtaatggaaacatagctcaacctctcaaaaaaaattgagatgcaaaataataaacttttaaaaggtaacttaaatataatattaaggaaaacagtgatttttccatctcggcattacacattgggcacttcacaaatgtctttatataaaataatatcatgtactatttttcccacttaaattgttcaggctatgtcttctcatcctgttgataagatcactctactagaagaatggaaactctctcagtcaatattttatgaaatgaacttgctttggaacaaccgcttcctcacaaagccatgttaactggagctcagcagtcactgcttctacagatgattgcaaattgactgacaatttgttcctaaggctccttggggactcaaattcaggtggcttgtctcatctataattagtaagataaatctttatcaaacatgaccatatctcttcttcagactttaagaagtttctccacatgataatcattcagaaataataggcagtaacgccagaataacacctgtcaatgcctgaagtaccaatggcgggagaaagatcataaagacttcttccgatatgtgtttagggatgaaaatgaggttctagttgagggtggccctattacaagcattttcaaggcaattggccaggagatccagaatttacaaatcctttcttggtctagctatcccaccttgagaataaaaagcccaaatgaagcaaagtaatgctttatattatagtgggagtggcctgaacctcactgtagagctctaataaactgcagtgaaccatggaggggtagggtcctctttcctgcacaggttgggtgtaaggagcctggaaacaaagcagattgaaaagctacttcatctcctccatcccaaacacaacatcctcatgaaatgaagggccagcacacctggcaatgctggagaaaaaggagccagagaatgtcttcttccaccataagcttatttagacacctagaaacaaatctttgaaagtgcaaacctaatcagtgtgctggaaactgactgatcaactcagcactcctgtcccagtgagtaagaagtagaggagggagttgagaagactttcttctcattgaggcaaaaaatatgaatagaggaaactatcaaatctagttgatatcatgtttagattaattctggggtcaaacaatagactccattagtggtgcttgttttgaaaggttctgaaaaattactatagtctcatcatgatcatacctggctggccaagtgtcagttatatattcaacattgtgttagtatttcaggtttccatatgctgtgctctggtataaacatctgaggattaaaatattgttcccaatatttcctgctgctttctcaacagaacaatactgggtgcttcctttgtgtctttcttcatatcatatattctccattaaaataaatacacattgagcatctatttttggggggactggggggaaaggtctcactctgttgccctggctgaagtgcagtggcacattcattgctcagtgcagcctcgaactcctgggctcaagcaatcctcttgcctcaacctcctgagtagttgggactataggtatgcaacaccacacccagctaattttagtagcaatgaggtctcattatgatatctagctggtgtcgaacttctgagctcaagcgatcctcctgtctcagcctttcaaagtgctgggattacaggcgtgagccactgtgcctggactctgagcaccaattatgtgctgaataatgtgcttggtgttaaagatctacaaatgcagagaaatgatctctgcccttaaggaccttacaaacaggcataaaaataacacagtgctttccataatttcttatgtctagctacttttgctcaacaatatgctttttgagatttatccatattgctccatgagtcagtagttctttcttttaaattgctgtgtaatattctattgtgtaaatacactataatttatctatccattctactgctgattaacatgtgggttttctttcctcctttcctgtcttccttccttccaatagacagtggctattaagaacaatgctgctgtgaataatctagttatgtgtcttttggtggacataagctcccatctggatattgggtacatgtccaggagtagaactgctggaccatagggttggatgcttggaaaaatttatgcagaatcatgtgtatgcaggtagacacatcctggagtggtgtaacaagccaactggcaagtagaagaccacagttctagtcctagcacagccattacctaactttggggccttaagggagccatcttacctctattgttcacagcttcctaatctataaagtaagttggagccaatgatttttaggtctcttttagctctccacatgtataatgcataatctcactttaaatggacaagtttcatttttctatttgatttctattcctctaaatagcctagcatattttttctgcatttgatttttatgcatggacagtaatatttgttagcaagatgctgtcatactttaaaattacttgagatttcttctgaagcagcacatattagtattaaaaaacactgctccttgcttcctgtatcagttccagagaaaatcataaagttaagactatttggtagaggcattaagtaaatcaggcagaaacataaagcagcttttgctgtaagtatagcaacctttggtaacaataggaaaccaagaatctgatagcttttagtagaattttgataaaattcatgtatgaatgtttgagctcagtagtgtgagctttctgtgacatttatctaactatgacctttaatgttaggagtacactcatcacctgcaaaataaatttgtatcctaaaataccttcttccaagcatttggtaaggagctttgataagacttaggttggatataaggtaaaattcagtatactggagataaaagcagggattctattcattactcttaaaattcttatgcccctttttggaaaaaagtctaaaatgtagaaagaatgtgtttttgagagttatcagaagtataaataaatatgagatgaaatactgacaaaaataatattaataaaaacaacaaggcagcttaagaaatattaaaataaacttttttgtgtgtatggttgccctctttgctagagagaatatagccttttttaaaaggcgggacttacaatattttaaagagaaaaaattttttaataagaactaagttgaatagttactattttataggaagctttacagatgaatcagtctgtagcttctgagcactacaggatacaaacagtagatctgagaagtaattattttaattcacaacccactagagcaagcttgtccaacccacggtcctctacatgtagcccaacacaaatttgtaaactttcttaaaacattatgagattttttttgaggttttgttttttcttttcttttttttttttttttaagctcatcagctattgatagtgttagtgtattttatgtgtggcccaggacaattcttcttccaatgtgatccagggaagccaaaagattggacacccttggtatagaacattatgaagtaaaaagtaaaaggcctcagccagttccccacatctgtctcttcccaacccacttcccagatggatttccatttaacaatttaaaacatatccttcattttctatgtagatgttgttatacatgtatctactttattgatttttaatacaaataaaaccaagcaatccattctattctctcatgaaataatatttcatgaacatctttgcatatcaatagggataggctgatagcatggtattccattttatagagacgttgccatttactatgtcttggcaggctcgtacaagcatatccatagggtaaactcctaaaagtagaatttgctagatcaaagtgtaagtttaaaaatcgttttttgaagtaacaaggtgtattatattgttttaacttgtatttctatttattaatgagattaagcatctattttctttttttaggatttgcttatttccatactctatccatatttctattggattgttagtatttttcttatagactgatataaatactttttttttttttttggagacagggtctccctctgtcattgaggctagagtgcagtggcacaatctcagctcagtgcaacctctgcctccccgattcaagtgattctcctgcctcagcctcctgagtagcagagattataggcaagtgccaccatggcccgcctaatttttgcttttttttttttttttttgagatggagtctcgctctgttgcccaggctggagtgcagtggcgtgatgtcggctcactgcaagttctgcctcccaggttcacgtcattctccggcctcagcctcctgaatagctgggactacaggtgcctgccactacacctggctaattttgtttttgtatttttttagtatagacagggtttcaccgtgttagccaggatgatctcaatctcctgagcttgtgatccacctgcctcggcctcccaaagtgctgggattacaggtgtgagccactgcacctggccttaatttgcaatttttttagtagagatggggtttcaccatactggtcaggctggcctcaaactcctgacctcagatgatctgcctgcctcggcctcccacagtgctggcattacaggcgtgagcgattgcgcctggccataaatactctttttatattatgtaaagtgctctttaacttatatgtatatatgtgtgtatatatttatgtctattaaattaaaaataatgttctaatttgttatttatcagtttttttccactattgcatcttgatttaacatcatgctttaaaaaccttttcattccacaattgttttaaataagaaacctacattttttcctactttttaaaatgtttccttcttttcattctttctttttacatctccgtctgtgaaccatatgcccatctggttttgcataaagaataaggtcgggaaagcatttagcactttgtttttccacatgactcagcagttgtcctatcatcatttaaataacagtccatcttttcctcactggtttgaaatgccatgttttaaatgtagcacttcaacattctactgcatcactaagtccaatgttccttccccagataagtcagtcactttgaagaatatcagggaatgaatgaaatgctatggaatggaaattcatgcccatttacatcctctcagcagacatgaaaatattttgcctcacattatagtcctttgcaaaatggtccataatggcaatgagaaactggtattcccatttgtctcctattcttccctacaatttaggtaataaggtttttgtttttggatgacctaaatataaaagcaagctcaaacttcatttataatgcaagacttacccacagaagaggaataactaagagactgaagggattactcaagagtcttttaaaattgatatgaaagcctccctcaggtaacagctccattaaggtctctgtaaatatttgttgaatgaataaaaatgtttgtctcttagaactatcaagggaaggaagtgctgcctctagcccaacactatgcaactgaaatataatatgagccacacttggaatttagattttttggtagccacattttaaaagacagaaagaaataggtaaaactcattttaataatacattttatttagcccaatgtatctacactatgatcacttcaacatgtaatccatgtaaaaaagtactgagatgggtacattctttttttgtactatgtctttgaaacccggtgcgaacggagtgcttccatcccactcagtttggacgagtctcgctgcaagttgctcaacagcgacatgtgcattggatggcacagctctagactctccatagctcctgtagggaaagaagctgcaacacagggtggctgtgctcccgaggctcattaagcacaaagaatttgctgaacagagaaaagaagactgaaatgactcccctgactccctatggcccacatttctgacgcctcctgggtcctgaagcagtgcactggcagcaactacaagggttactcatttaagcagtaggacagggaggaacacggactcctaatacaagcctcactacatcctgccaagggaaaaggattttcaaagttaactacctggctgcactaggttaggaaggtgaaacatcagttacgtagctcttcacttattttcattatcttcacttctgttggccctagctgttaaaaacaaaataaactagaattttcttgttcaggtttctgactttgaaatgtaaggtataaaaagagggtacatgtcattaaaagcctaaaaagaattttagctgaggtagctgaaaaagggactgtcagagaaaaccacaggaaaagccctgaacttcacaccgaaaggtttaggttagagttaggtctttgtcctcactggttcagtaatcttgggtggaccacataaattccatggttttggtttccctagctgtacaaaatgggaaggtaacatcaattttacacaccccaggtagaaatgggcatgggttaaagtgctctgtaacatgtaaagtgctatatgaacatgagttattcttactattcagagtcccagcttgccattaacttgctttgttgacttgggcaagtcatttgaccttgggtatgcctcccatttctcatttgtaacatgaagcaagacttaatgatctgtaaaattttatgcctaggtaaagtacaatacctattctcaacccaaacaaaaatatcccattcaaaatattcaataggcaaagacttctgtgttgggaatagggtcctcaggtattcagtgaccagaatcaaacctaatggagccttttactcacccaaatgttttttgagtgactgttaaaagccaggcacagtactaaatgagggaaatagggaaacagagacacatcttttctgactcatgataaaagaaaacctaagaaacagcatgatggattaaggataggaggcacaaattcacgtgtctgcatagcttgggcagttgaggtcaatgaatgaagaaggccagatagagaccaacagagaatggcaggcacactatagtgaactatggtcaactggggactgtctgctttctttcaatgggcaactacttggcagggtcaactgatttttttttttaaggaaagcttatgtaaaacctcctgagtttacatcttaacaactaatttttaaaaaccactctaagtcaagcataaaagtcatggggatcgtactagttggtgatctctgatttagggaagaaataatagagaagaaaatagtaggggtaagaggaaaagcaaaaggccctcagaatctcagaatccacaagaagaccttgcaaagtttcccaggccaaccatccaaccaacgacccagaaatgaaaaaggcaaagagtttcagagagattaagaatagtgtacttaacccagcaattccactactgggtatatacccaaaggaaaagaaatcattttactaaaaagaaacctgtacttgtacgtttattgcagcactattcacaatagcaaagtcacgaaatcaacctgagtgtccatcaacggtctactggataaagaaaatgtgatataaatgcaacaaaggatattatgcagccataaaaaagagagaaataatgtcttttgcagcaacatggatggagctggaggtcattatcctaagtgaaatcactcagaaacagaaaatcaaatactgcattttcccacttataagtggacttaaagatggaaataacagacactgaggatgccaaaagtgggaagatgagaggcaggtgaaggttgaaaatttacctattgggtacgatgttcaccatgtgagtgataggtacattaaaagcccaaacctcaccaatatgcatgtaataccaatgtaataaaccagcacatgtaccccccgaatctgtaaaaatatatatatattatatatcatatataataatggtcatattatatatattatatataataattatatatacatacatatataataatgttggtcaggctggtctcgaactcctgacctcgtgatccacctgcctcagcctcccaaagtgctgggattacaggtgtgagccaccgcctggtctaaaaactatataaaatatataaaatattatatattctatatattattctatataaaatatatattctatatattattctatataaaatatgtattctatatattattctatataaaatatgtattctatatattattctatataaaatattacatattctatatattattctatataaaatattacatattctatatattattctatataaaatattacatattctatatattattctatataaaatattacatattctatatattctatataaaatattacatattctatatattctatataaaatattatatattctatataaaatattatatattctatatattctatataaaatgttatatattctatatattctatatattatatatctatatattctatataaaatattatatatctatatattatatattctatataaaatattataaaatctatatattatatgttttatatatatactttttttttttttttgagaccaagtctcgctctgtagcccaggctgcagtgcagtggcgctatctcagcttgctgcaacctctgcctcctgggttcaagcaattctcctgcctcagcctcctgagtagctggtattacaggcgcatgccaccacgcccagcttatttttgtatttttagtagagacagggtttcaccatgttggtcaggctggtctcgaactcctgaacttgtgatccacctgcctcagcctcccaaagtgctgggattacaggtgtgagccaccacccggcctaaaaaatatatttttaaaaaagaatagtggtagatgttattgagaggacaaaatgacaaaaacaagagctaagaaaagtcagttcgtagcaaacaggaggaaaatttcagagactggagtgaccagaggctaacactaactgcagggagtaagaaagcagaggcagagagcaggggtaagcgattctcttgagaagtttagcagaagtaagaaaaaaggtagaatcataatttgaggggagtgtagtcaaggaataggcttttggggagcgtaaaaagctgatcattttcctatattaaaggatagccaggggaaagggaataactgacatgcaaaacagtaaagatataatagatgtgaccaagttcctggaggatgaaaggcctaggcagagaagacagcaaccgcaaaggaagaaaaacccttcccaactgtgaacagtgaatgtgcatacaaatttaaaagttcaaccctgaaaattaagtataaagaggtacaaatacctattacttttggagcaacagatgtacagtctattcatggtgctggggagagagaccaatggataatttttaaattggtctcagttcacttcactgtgtttactggttctgacaatacatgaagttttatatatatgtttccattacatatttgttcactgaatgcacaccataaatcagaaatgtctgttagccaaaagtatcattccaatgacaaattttattttctacaacctgattaccagatgtagggatactataaaagaaatatacatgtatctcaggaggttatgaacatggaattgtcattaattctaagtgaaaatttgtcaatgtgaaatgacacactgacagaaattccacagtgatgtgtaatcagctaataaatcagtgaacaagtatttcccctaccctggatacttaaagcacgtgtggatgtgcatgggggcagggtgggggaatggtgatcgccaagaaagaatctggcacagaaagagaatactgtaccaaggatattgaccatcaggactttgcacgtttgtttgagatcttccttcctctcaacatatggaggaattttcgccccacaaatatgtgaagcctaataggtacattatcactaaactttattttaaaaagcaatgttgttttataacacttaggaaaaatactttcctaaaacattccatttcattctagagaagcctgttccccattgatgtaataaagatgctcctgttcaagtcatttatatgccacacatgcacacacatgctggaccagtatagaatattcattcagtcttttttacacgatataagacatgacttaacatttgattaattaaaatgaatctattctgcttattaaagctttagttactggaaaaatttagtgtgtatatagcaataataaaatatttaaataataaaaataaaaagttgaaaagacattaaaatatcatggttttaattagtttgtgatttttctcataaaaaggcaacctcagatatttaaaattgttgagtagtgactcatttctgaaaattaaccttttaggtgtgagaaaatgaaatgtttcataatttgttatgaaacattaaaatgccctatacactttttaagcaaagttggataataatagtgattctgcccaaccattaggaatgctagttattgaatgtgctctgagactagggcagggcagaagtctagggaagcgatgaactgcagagtggaggccacgattcctttctcgattcctggctctgtgtccccctgagcaagacatttgtctacaaaatggtaaaaataattaaattataggttagctactagagtgtttattagacagtcataaaaactgatgtttagtagtactacaattatatggcgagaggcaaaatcatgtgtgtaatatcattaaagcataaggaaaaagaatggaaggatatttaccaaaattatacacgatgagacttaggattattcatttcctttccaaacgttctggaacatgattatattgtagaaataaaatcattaaaaatatcctttacataagatatggctctaagaaacacaggaaaataataaatcatcaacaaacctaattatacacttagcatgttccaggcaagtaagaatggtacaaacggggtactgtagaagttcaaagcaaggagagggggttttttttggttctgtttcatagaatttgttttgttgcatacgaaaattagggaagaaaggcttcatgaggaatgatagtatttatttggaccctgaaggtgagctttctatacagacaaagaaatatccctgatgagctgtaaagagagcagttccagggtatgttttccaggaattatcagtaaacttaactagggccctgggtacatgtagcaaaatatggccaggttaaagaacttggcgattctttagggagtcattgtggaccttagataccatttggtgattagcctaggcctctgattatggctatgcaggaaatctgcgtttttatgttctatgaaactacctagagtactggaaactgtccattcgtgaagtgggaactccataaacattaaccgatctttacaatctcagctctctcaatgttttcctgatggaaagcaaaaagaaactcttaaattagaaagaagcctctgaataatagatggagcataaactaccctaaatccttacctaaacaactcctttttagattgagtctttagccatatttattaaacagccgttcctggagctcagaggagacctgcttttgcctttagaacttcaggagccagtgctcatttttccttttccttctattgttctggcagaaggaaaagcaataattacttgtatcaagtggatagcattcagaagatatgaaaacctacaccatgggacatagtctacagtgcttaaagaaaaaaaagctactcaaaggcagatccaatgtattcagtcagaattacagatgaaagtatggtgctaagcaacgagtaattctcccttactgacttctcaacaatgtctttaaatttcacttacaaaaatttatttacttcaggtttgaaagggaaatttggatgctaagcaacacagtaattccctcttcccaacttacccacaatctccctaaatttcttttataaacattgatttaactttttaatttttaaaggaaaataatacatctaaaggaaaaaatatatccaaaagtataaatgatgctatctttttatatagttcaatcaactctttgattattagatcaaaggttattattgtgcccttctgctatcattattctcaagaggaaaggcttttagttaaaaaataaagttagcattgttattcttagctcctccaggggtcaccttggcaacttcaaactatgtacctacacttctacttcttattctttggaacacagacattaccttccaattctctcattccctagaagaggaagctagcacccccacctttaaggccacttgtgctccctgagccctttgatttcccattgttaaggctgataacacactctatccatagccagagaaatgtctcccatgatttgtctatggttgattctagaaagtgaatacaactaattactccaaattgtacactttaaatatgtgtagtttattgtatgtaacttacgtcaataaacttattttaaaagtgaggatccttgacaataagtctgtcctacctcagctcaaagtaagtcaaaggagaaattgcaaataggtgaaaattcatctcagaaagaatcagtgagtcttttcttcttaacattttattttttaaattgacaaaattgtatatctttatcatgtataagatgatgttttaaaatatgtatacactgtggaatggctaaattgagctaattaacatacgtattacctcagataggtatcattttttgtggtgagaacacttaaaaatccactctcagcatttttcaagaatacaataatatactgttattaactatagtcaccctatagaactcttgaacttactcctcctacataactaaaattttatatcctttgacctacgctacccccaggggggtcttctctacaaagctggccctctacatgcatcttagggccccatgtccgaggaatggaggactgactgcagtacgccattttatgtgagggacttgagcatccgcagatttggaaactgtgaggaatcctgaaaccaacgccctgtggatactgagggacaactgtatttaagaaataaataaccagtagagattacaagatctaagccatagagtattgctaccattaatttgggaaaattctaaactaggtacaatcaaatagcctagtttttaaaaaaacaggaaaaaagcttgcattaaggtcacatagaccagctggtctgaagaatgtaacatcctgacgtaacaccaagataaaccaatgataagatatacacataggcagtgaatgatgggagaattagctgaaaaatgtagaagttggcaaaatctacaaacatgtttgttttgagtttagaacctttcattataaaagttcataggttgctcattcattcaaccaatatttattgaaagcgtactacaggcgctgtgcaaagaccctgcggaaccggcccttgggagtttgaattctaatggggaaatggagggtgaggggtcagctagtaactacatcaacaaataactggaaatactcacagagagaaaaaagggttaataatttctagggataataataacaatggtgataataatcacagccatcactgacattgctcttgctggtaccaggcactattcttaagtatcactggaacttattattttacaaatgaagagccaggcccatagtcacttagataattagtagtagagtcaagattggaatcctggccatctggctccagagtccaagctttctcccactatggcaccagtatgtgtttggggtacagcaagtgaagaggaggcactcccttagatgaggtgagagaaagtctgtcagaggaagtgacagctgacacgagatctaaacaaatgagaaatgtagcccttgtttctagcagtaactactgagtaagaatagttgtctatgaggccactccaacttcaggccttctgcacattaccttttatcatctatagcagaggagcaagttgctaaataacttttttggtgttgaaaaactgagtgggcgatatttcaaacaaatgactaggaatcaaaataaaatgagaaacttaataaaaatttatagttcaccgtaagcctacaatacacaattatgtttgggaagcatccaaaattccatattcagcacttatttcattcatattttttgcttgcttaagaatcatgtcatccaaacttgaatgaatgagtcagctccaaattaatagggttaaaaatctttccttctattttacagaaaactagtgtttttgaacaaagaagcagattaaaaatctgtttttttaaaactgtattcagtccttaaaaaatatacccttttatacatatcatggcatggtgtcttcaagaactgcttttaacctttactattttccagcttacacaagtgaagaaagggcctgtctaaattgaatagaacccataacctctaaggctcaaccaaagagaggtctgaaagaatctccggaggggaagggtgaatgtgatcaaagcaagagaacccttacccttatcttaagagctcaacaaggactccaaggcaaagaatccagggccatttatatagccattctttcccctactcacttctcccaaccagactctcctccattcaagccttgaaaaattttgtgttctactttaataagcaaagtgttttgcattattaaaaggagatgtggctgggtgcggtggctcacgcttgtaatcccagcactttgggaggcagaggcaggcggatcacctaaggtcaggagttcgagaccagcctgaccaacatggtgaaaccccgtctctactaaaaacacaaaattagccggacgtggtggtgcatgtctgtaatcccagctacttgggaggctgacgcaagagaattgcttgaacccggaaggcagaggttgtagtgagccaagattgtgccattgcactccagcctgcgcaacaagagcgaaactctatctcaaaaaataaaaaaggagatttgtttgcaagtcactgtaccaccatcgctattttatcaccttactccagtgcacgtggagatcacagtccacagtcacatgatgttgaggaagaaaaggatagttgaggacaggaagagagggcaaactattccggtagcatttctcaccacctcaatcctctctttacccacctccagtgctcagctccttacagtttaccttccctcctaattccacagctccacatctgaacctctgacccagagattctactacaggtccacaatcctaccccaaggcccatcccgtgcagactttctgccctaggagagttccttgggcatatccattacctaagtcggccagcaggagtcgagggggagtttcagcttctctcattacacatggtagttaggttcttttatttgattattaccatgctctggtaccctctgcgtgatagtctaatctgagctccaaaccactatgcataagacatagtggtgtcagacccttggagatacatcatctcattcaatcttctccaaacttctaggagataacagtttttggcaggactgtacaaaaaaagcaaaatacctaacactgatggagacttaaatgtctatttataagatataagagaattatttaccaatttttgtgatgcagcctgtttttatactgggattgtctggcccctgaagtggggcaaatatgaataggtttacagagctagagaaagaccattacttaagaaaaagccccagtttttattcctatagtttgctttaccacagctaagaatgccctgtaagacaatcgacattactgaaatagttgaatttcagtaggttgcaattgaagtctgcctccactttattcccctaagggctaaactaggtgtcactaatccctagatgctctgctccctaccaggaagttcaatctgatggcttgacatcaaagaaatgttcataggctcctaaagatagacagcttgtttaccacatctcaaatggcaagattctggttcaagtgaggaaaatgctcatttgaaagaaaagaagcagaatgaaaatactttctacttgggcagaagtttatctttccaacttaagtcagagtaaataatcctgatgagtcaagtgacttgaagtgactctggatttgccatgggtggatcttttatgcctatctgcacaattctatactcgcccaataacaaaaatatagtaaacccttttcatgcatcacaaaccaagtatcagcatgtaatattgataatacctaaaaagtaaagacaggctttcattactaatcctgtgcttacccatgctcttcagtgtaactattcaaatgcttggaagtgcttgtagtttcccattacccacagttagaatatatacataatgtacaggaaggactgcctgtgagttaagggttgtttggtttttttctgttgtttgctttcaaaggaggaaaaaaatatttcaataaacaggaacatctgaagagtatggataaaattcaagactcatacatggtttgaattactttcccatggatatacagtagtcaaattgattttttatgaaaacgttggcaatctcactctctatggaggaaattgagtgctggctacaatgatacagtttgtcattttagttttcaagatcatgccaaaacaaatgcctcagataaaaagactgcaaaataagtgacagtggtttttcagttttacatgcttaagatccgtgctttgatattttaaacaaccagattactttcaattccccaaataatcttgtgctctctcttactttttggcttttgaacacgctggtctccctgtctggatgtcctgccataaaatataccttttccatgtctcttagttaacccttatttatccatcacacagatatctactaagacctcacttcttaccagaagccttccatggcctcaactaaccttgaatggttgtctgggccacgcttccttctttgaaaatgccttcgattttattttcagcaagaaattcttattcccaaaggacatttagtttatgatatatgatgtaatgaaaatctactatgaattgtaactcctttatgttcagcttgtattattctttaaagtaatacaactatgtgactacacatactctctaaaaagactttactatgtcaagcttggccacaagctttccaagcaaagctgatttaaaaagggaaagggggctaagtagttgctgggatgggatggaggaagattcattgacttatttaacaaatatttattgaagccctactttgcatatcactattctggttctgctgatgcagcaagtaaccaaagaagtaagtaaaaaataaacaaataaacttttctccatcttacttaagaactttatcaactttctactcccaccaaagccagcaaatggaataaacaggaaatagtgtaggtgactgacaataagcatacagtgacatttaacaagacacaggaatgcttttagcagggagaaaaagtaaagagtttcaagtatctcactgtcttcaataattgttggataggatggaggaattcttcctgatctgtccagtgatctgtaacagggcattcctggtgctttttgttgtgaggacttcttaatactcaaattgcataattaagatttatttagtaagctgaatattaacacagttcaagtttctacagattaatttacctcaacatatgaaattggaaatattcctattttgtctgccagcattccttcagcccagttttcatccactcttcggatcacagtcagaacatcatcctgaagaaacagcaaatcattaatctacctgatcattaagctgtaccattaagcttgtcatttaattttccttttcaataaagagactcatgttttaaagagtacatgaataaaaatgctatgacatatctttagtacatggattaaatgttttcatgaattaaacggtagctaccagcccacctggtgtcctttccaactgttacaaagctatgaactcctatgcaagggagctggctgctaactcttaagatctacaaattgcaacctcaaatgatacctaccctagcctcctgagtttgttttagattgattctcagatgctcctcattttctgaaaataaaccaaatgcctactcaaatgtacatcctaccgcttttctccacaaaaatcacaaaattctgcttaaaactccaaaccattttatcaattcggcagatatattcctgtatgcttttaggcaaagaattttacatataaaatatgaaagtaatgacatttcattttgttattcataattcagtactttaaaatccctgagtggtgcatacaccctttaaagtggcttagaaataaattcagactctaaatatgaaaatgataccacatagagcatcaaccaagataatctttcatataagaagtctgtgcataaaattaccttccttgtgacttaaagactgcttctaggcattttcagaagcatagtgagtagttcacacaaaacttgtatttttttttgcaaaaggcaacacgagctatatttctatgtatctgggtacagaggtagagctggcaaacagaaaacaagcacattctacctttacctttgcaaatggaaggcaatctttgtctgcttccttgtctttcacttcaaagtcataaagtgctttgcactgaggtgggggctgaggtaacggtttaataatctgcacaaagttggtggggaaaaagccatggattccattgacttccccatggtaccaattttcatccacttgtcttcgcaaaatgatgatgtcacctttgctgaatttaaggtctccaggctcttttccttcatagttgtataatgctttggcacatggtaactgaggtataccctttaaaaaaaaaagagggatgaattttaataaaataatggtcttaaaatgtctctgaaaatacaactgcgttgtcattgttttaaagtcaaagtcaaaaccacactgtaacccttgaagaaaatctcacacaaaaacaatatatatgtgttaccaataaatagaaaacacaaaacaattgtccatagtgacataagaacagtacgacacccatgcaccagccatgatttaggcttctattcttaagtttaacttggtgggtgttttgccttctttctttgaggttatcagtatatgaaagcatgactgccaggtctgcctctcaagaactcataaaaaacaagcttaacttcctacattaactactttattcatcaggataaatgataaacactgaggagaaatgatagatactgaggggaaaaatttaaaccaaatttattaatttactaaactgcttttaagcttggttgataaaaatcagagttcggcttttaggcaaatctcttcctgatattgcttttaatgtgggcagtaggtcttactctttcatgagctcaatgagtatttaatgagggtctactcctggatacagcagtgagtgaacagtcacagtacctgccatccccaagtttataatctgtaagtgtatagacacgtggtcttttacagcctaagatcattcaactttgctctttcctggaagagagcacattgttaggctgataagctaagagatgaggaatttaatgttcctgcattgcattactgttttaaatgacaagtttaaaattgtgtacataaaccccagtgcaatttaatcatcaactgattaatatgatacttttcaacggcattgggggtgcccaatcttgagcatcagttgtcactttaagatctttggcctctctgagcgctgttgcatatcgttgattcaggagataagtggcaaatccaacatgtctataataattccctgaacaagattacagggctcctgcttttggagtctttatttatttattcactcttccagaaaacatttatcaagcttttactttttttttcttttttttttttaagacggagtcttgctctgttgcccaggctggagtgcagtggtgcaatctcggctcactgcaacctctgcctcctgggttgagtgattttaacgcttcagcctcccaagtagctgggattgcaggcaagcaccactatgtctggctcatttttgtatttttacaaaatggggtctcgccatgttggccaggctggtctcaaactcctgacctcaaatgatccacccaccttggcctcccaaagtgctgggattataggcatgagccatcgcacccagtgcaagcttttactttttaccacgcaatgtgcaagtgctgatgacttaaagaagaataagacagttcttttcttaaaggatattagtaataactacaatacagtgtaataaatgtaatgataaagatatgcacaccatttatggggacaaaaaacataggtctctcgtgtttggtgagtaggaaaatgaaacacttcctggaggaagtgacacatgagccaagtcttaaaggatgcacaggaattagttgtcaaggttggagtgaatgaatgaaagagaacagtaagggcattccaggcagaggggtcagcaccagcaaagacctggaggtaagaagtcacatgtgcagcgggactggggagcataaagaatgcagtattcctggataagaattacggaacataaaggagaggtaggcagaggccagtttattgagggtcttgtataacatatgaaagagtttttattgctgcgttcttctggtaatggtaagtcatttccatgtttaatgcacaaacagacttaggtcctatgtgccggacagatcagtctggcagtagtgtggaaaatggacgtgaagtgggcaggcaggcagagagctatgtgcaaagcacaggcctcaactagttgaatattttttaagtttaatatttccaatgaagtagagcaatatagttagcattacttatatcattgtctgccccccgacctgtaaaaagtggatcaaagttttatacccttgatggcaacagaacttcataacacaattttcaaaaattagtttggtttctacttagagacttagagtctggactacctataagccaaatttgttttgctaaacatttgtttaggaatattaattattgctctcaaaatgctattggcaatcatcttgccttggcttagtccatgtgatgttgtagttggttaattagaacttccctgagaggccaatgtcctgggaagacaggggttgagccttccagagtaatgacaccctcctgtgacctctgactttcagactctgtcttaagatctggcctccaatggcgtcacttctgctactctgccttgacctaatcttgtaagcaattctgctgtgcccagaaaggaaatgcccaccaagaactctggtcattcacaacgctgtgtactctggtcacattacattagtgtccaactctggggaaagaagaattctaatttttctctaccctcacagatgcctcattatattctccactatattatgtatttcttcaaggctagttatcacagcttaacaacatttccaaaaataggtttgaggaaataatagtaaaacacagcaatcgacagagagagagagatagagagagagaaagagagagaactggcaagtactatactaaatctcttgtacaatagctaaagagactctgatcaggcagtatagggtactggctggaagcacaaactccagagccagattgcagggtgtgaatcccatttactagctctgtgatttggggcaggttaactcgctgtgcctctttcttcatttgggctgttgtgaggatttagtgaattcatatatataagccacaccttaaatgacccagcaggcagtacatgctacatgtgtgaaccatcatcattgtcatcatcgtcatcattacccagtgtaaaaagcctctttaccagtgaaatggggcacctgacaatgcatttgtctctccacagctggatgctttcccttttagatgaattcacatagcaattacatttttaatacatattcactgtataacaatgcaaagaatgttcctcctaggaagtgttcaggattttgaaatgtgcatttctgaagcacacatttgttttctgagtagaatccattcatcttctggttgaacagaagaaattacaaattcactgacatgtaccgtttaataggggatggcattttagatgtggctgtagttcatcttgacagggctaatgtaaggcattggaagcctgcatgaattaattgaaaatcccattacaaactcggtgacaaataactctattcaccattatggcctgtttttttccctacctcaattagctctgtttggcccactctgtccaaatccatgccagccaaacccatgcaccaagatacagatttagcactcttagaaaccattctgaactgctccttgaagagatctgtaaaattccaaatgacccacaatatggttttttgtgatatgctgatgtgggaactgaaggaatttatttctttacagatcacttccacacaccagtggcctaatggacttattaacttttccacaaaacaaatctattacatgttcctaaaatcatcaaggattctaaatagaccagtggcaaggagaaagcttactatgataacagtgatatacattatggttagcctagggttacatttccgtgatgcaactgaaaattcattaattcaccccaacttgctaagtcttgactgctaaaattgtttcaatgatcaataaccacaaagaatcataaagcttatgacaatctaacccatgaacaaacatttgtgcatctggctgtgtttttctatggtattctttttcaattaaattctatgaggctagaaagccagtttgggtcaagtttctaaaaagaaggcttcccacattaaataaaatgaattctactctgattttaaatcaagcaaagttcagtgatctttgaaagacttattcccacacagactgcagatgattaaggataaacggttaaacgacttggaaaagcaataaaagaacacattttccttttgcaacatctgaaagataaagccaaaacaattggtttgatagcctaggactactctgtggataaaatatgtctggagcccatggaggcactgccctctcattcatctccttcgaaaggtctgagagtcatgtcatcactgggccctctgccctccaagccttctgcaggctttccaaactgctgcttttcttctgtatcctctcatcaggccaaggcccccaaggatccacagagcttacatttcacttggagactttcacttggctacacatgaaagggatgcttaaaaggagagaaagccaaagagaaaccgactctgcagtctaaccttgggtttgcggcttgtcattcacactgccagctttatcaaaaagcttggcaatttagacaggcaaactgttacagtaattctgcatctaaaaacattttgataaacatctactatattgttcatttaaaaaaataagtatgatagtgggccagctttacatttcaaataatttttgtttccaaatcatacatacaggttgtcttttaagatattaaaatcctcatgtgatctgcctataaatatttttgattaaatgctttcgacttccatttccataccatcagcggtattccaatacatctggcaaaatgctacttgatgaactagctgagattctaacaggtaaataaaacattcactgccaatttattttatagactctaaatgccaatgcccagatgtacgtgcaagacagcctctctaaattcaaattccttcatgcatttcttactgctccataaagtaaaaaagattcagtgacctcctaaaaagaaaatctagaagacactcttgtagtgggaacagctataaaatgtgtataatttaataactcagttatatctaaattggcatcaatgctggctgattttaacttgactttcagaaactttccagaaagaactgaggcacaaagaaatcatagtaatagaaagtaccacacagagtaagaagtagaaaaatgggtggaagaaacaattttttaaaaatatcttttgggtcaggcacggtagctcacacctgtaatcccagcactttgggaggctgagacaggcggatcacttaagtctagggagttcaagaccagcctggatgacatggcaaaactcatctctataaaaagtacaaaaattagcacggtggtggtgcgcctacagtcccaactacttgcgaggctgaggcagtaggcagaggttgcagtgagccaagatggcgccactgcactccagcctgggcaatagagtgagactccgtctcagaaaaaaaagtaaaaaaaaatagaatgtcttttgtacaacaaaaaacatgttggcttttccctacaaagtaaaatatctgtcaagatataataacagtatttcatgaaaatattgattctttaacagttaataactcctaagtattgttctcaagatatctacatcagataatcactcaaatatgatttggccatcactactaatgtttcaacttcaatgacggccaagacgaatattaaaggttttatttttccaaagtaacatcagaagggactgagaatcccataattccacaatagtccatctttcatttgttctttcctttaacatttatttctggaaagcactgtgctggggaatttttatctgacaatcattttcttaatcttctacctcccacctaccccaaattcactacataaaattttctaatcatactaactttaatcaaaactaccagcactttgaggatggcagctgcaaataaacagaaattaagacaaaacgttgtttcttcattcacatgtcttctttttgcctttattctactatcccagtgtccccttttcttgcatgctcattttctccagctttctccagaagtagactctgcagccagccagcccccctccttattccagacctggttccagttccataccagctcaagaatgtgggctgaccaaggccagcctttgggcttttttagcgcttggtggctcctcagcacacactctgtgctgtctgctgccctgctcacgctcatctgtgggctccacaccctccatcctctccttacccagctcctgcaatccaatccaccatcgctaatggagtgtctaactcagctcttgaccaaacagcaatcagtcaattatagtctccagcagccttgctgttttgcggggggcattaatggtttcgggggcaaggtagagggagagaaaaaaaaaaacaaactagagataaaggaaagtagataaagtagctttcttaccaatttccctgggctgtactctcatcattaatcatttgcataatgaatttagctgaagtcaagagtatattcaaacacccagaaaaaaaaaaaaatgaacaacagttttccaaatttcaaaacgaaaaaatgctattagactcttcattaaatgtttttttctagaaactaaaatacagaaaacaaactgaaatacatttgtcccacctcctggattttcctctcctacaagtacaggagaacctgaggcagcactcaggagcatgtttaaaaggcaatgttgcaggaaaagtgggctaaggggcattgcttagtaaatacctatatttaggaggcagaaaaaagagagatacaggaaactagagaggtaggacgaaaaccagcaaactataaccacagtaacaaggataattcctgaaacacggttttgtccacatcacctatgtctttacaatctggagacagttcccaattacctcttaaatcacattaatggtctaaatcatgagttttatggccctccatttggattgtctgttccacctcatattttccaccctcagcaagcaaaccagtctgctgtcatcacctccaacttcatacatgccatctctcctccaccaaaattcatcgagaacagtccatttctccctccacctccccaccttgtatatgtatcacgtgcctgataattatgctgcatttctttcacttggatttttatgtctgtctaggatgactgcttttgttgtttggaatcaggtgtaaataaggccaagatcaatgatctgattcttgtgtgggtcaataggacagtctctatttcccagatgtgacagccactacttgtccatcaggacccagcccaggcattgcctccttggggaagcttctcccaaccttcctctacccaagtctagagaaggtgctgctctttttatgtacacctagagtgccttatgaatactgttatcatggcccttatcttactcagtttataacctatttcttcctgctagactgtaacctcctggagacctgggactatgtgttatgcatctttgtatcatgagtacctacctcagtgtctgtgaaaaacttcttgctgaataaattaatgaaagaacaaaagttatctctagtggactgagtggtaaggtgtggataggttaagtggaaaaagaacacatctaaaggaaaagcaactaaaaagatgattctactgacaggctcaacagttttacacaaattgcaaaatatatacaaacacatatttatgtgtctctgggaactcctcatgaatggtagactgctaatccatctttttgaaactgtcctcccaagtacacagcaggtggtgggcacttgattctgagacatgggaggtacagaaatactgaaggagacatttttattaccatttcctaggctgctgggaaacctggggcatgctaaggtgctacagaaaaacctggggaaacatgagcaggcactgcaaattggtatcaacttcactgtgttctagacactggaactaaaacatagtccgttctggaagtgggcagttgagtgtcttatactaagcaaatggctggcatttgaaaaatgtgaaacaaattatgcagcaaactacagcaaataaatattttccttataaactcatttggtggttaggaggaaacagtcatgcagttgatatggcatttctcttggatggccttagtacccaactgacagataaatcattaaagaaaacaaattttatgaatttctccaagtgaagatagctattgagaatgcagtcactcaagtaaaatgcaagaagtttgtgtcactcattgccttgaatattagttttctgtttcatcacatgtttaataattacaatagtattttgcagagagcaggaatatttactgggaagattctctgcagtaacttgagttaccatcttgaagactcatcacaggatggggactatttcctgggaaaaggtcaagtttctacctatttgaaaaacagattcctggcaaagaatctgcccttctcttgccactgccctgccctaggcctccaacctgaccctggggtgtagagctaaatagggaggaatgatcatgtaccaggaattctgcttgcatcttatctaatcctacagaaatccaggaaagtagggagattcagaaacacaaagggagaggggtgtgttgagaacatgttttagtattaaagaggttgggtaacagccacatgcagtggctcatgcctgcaaacccagcactttgggaggctaaggcaggcagatcaattgaagccaggggttcacaactagtctgggtgatctggtgaaaccccatctcttaaaaaactaaaaaaacaaaaaactagcaaggtatggtggcacgtgcctgtagtccaatattgtgccactgcactccagcctaggtgacagagcaagactctgtctcagagaaaaaaaggcgggggggggagtcaggtaaggcctcagtgaaattcaattgcctatttttagttttgtccagtgtttacattaacaccttggagagaggatgctcatataatttaaacataaggttaaatgtaaaagatagttcatagtttcagaattaaagcaatattgaaataaacctacacacatataaacaactagacaaaagcgtcaaggcaattcaactgagaaaaataaagtcttttcaaaagatgatttcagaacaattagaagcccatggggaatagatggggatgaatcttgagcccctacctcacactatacacaaaaattaatttaagatgaatcccagactcaaatgtaaaagctaaaactgtaagttttataggggaaacaagaaattaccttagtgatgtgtagggaggggaaaaaagcctaaattaaccataagttgacaaatttgactgtattgaaattgaaaaattaggttcaacaacaaaagacacatgaagaaaataaaaatgtaaaccacagattgggaaatatatatatatataataaaggactcaaatccagaattaaaatgactcctactaaccaacaatttgatttaaaaacaggcaaaagttctttcccatcttgccagatggtggtgaaaaaattgagaagctggatactaaagagaaggaacccgaagccacgaaggctgatgctggtggtaaggtgaaaacgggtaacttcaaggctaaaagccccaagaaggggaagctccactgtggccaaaatcctatccttattagaggaattggcagatattcctcatctgctatatattccagaagtgccatgtacaagaggaagtactcagccaataaatccaaggttgaaaagaaaaaggagaaagttcttgcaactgttacaaaaccagttggtggtgagaagaatggtggtaacctaggtggttaaacttcacaaaatgcctagatattatcctactgaagatgtgtctcaaaagctgctgagccacagcaaaaaccttcagtcagcatgtgacaaactgcgagccagcatcaccccagggaccattctgatcatcctctctaggtgtcacagaggcaagagaatggttttcccgaagcagctggctaccggctcgttactttgactggacctctggtcctcaattgagttcctctagaagaacacaccagaaatttgtcattgccacctcaaccaaaattggtatctgcaatgtaaaaatctcaaaacatcttactgttgcttacttcaagaagaggcagctgcagaagcccagatatcaagaaggtgatatcttcgacacggaaaaagagaaatgaccagtgcaaggttgatcagaaagctgtggactcaaattttaacaaaaatcaaagccattcctcagctccagggctacctataatctgtgtttgccctgacaaataaaatttaacctcacaaagtggtgctctaaatttcttaagaacctaattaagtaactgataacattaaaaaataaaaacaagcaaaagatgtgaatacacatcttgaaaagaagatgtttgtatagccatggaagggcactcaacaccatcaggcaactgcaaaataaaaccaaaatgatatattataatgcgttcattagaatgattaaaatttaaagactgacaacagaaaattttctaaaaaatgtggagcaactagaatttacatagattgctagtgggggtctaatactgattgaaaaattcttataaagttatatgtacatttactcttcaatctacccctcttaggtattaacccaagataaacgaaaacatacatccacacccagatttgtacaaaaatgcacatcacagcactatttataataccaaacactgaaaacaatccagatgtccatcaacatgggaataaatggaatcctgtttaactatttcaaaaaatgaattactgacacatgtgagtaaaaaaaaatactatatgattacatttataaaatattcaaaaacaggtgaaacgaatctcttgtggtaaaaatcacagtagttgcccataggaggtgggcaaatgagtgaaagagggtgtgagggaaatttctgagactataaatatattctgtatcttgacggaggtgttagttatcctggtgtagaaaggtatcaaaacctactagatcgtacacttaagaactgtaattcacacatacaaattttacctcaataccaaaggatattaaggtaacactggaaggccaaggtggtaggatatcttgaggctgggagttcaagatcagcctagacaaaatagtgagtccctgtctctaaataaaattaaaaataaattagctgggcatggtgggacaggcctatagtcccagctactcaggaggctaaggtagaaggatcacttgagcccaggaactccaggttgcaatgagctatgattgtgtcactgcagtccagcctgggcaacagagtgagacctcacctctaaaaacaaaaacaaaagcaaaagtatcacaatgagtaacaagccacactggctttcaagagaatggcaaaatgagaaaagaaatctgaaattcagaggtatggagattaatgcacataaagatgtctacttttccaaaaggaaattacagaacagaaatgattgtacataatgtactgtcactcctagaatctgaccttattagcaccagtcagtctctcactagatgtccaggatacattctgaatcccataaacaaaaggaacagagaagtttggcatattcagtagagagagataaagatgataaaagtgttggaaaatattgacagaaaagctgtagaaactgagatgtattagtacagcagtattattctagaataagtcttcaaataccatgaaaaggtcttacacaaagagagtaagtctgattggaactcgctgaataaaaaaatacaggcttaaactcatgcatgcattatttaagttggataaaggaatttcctgacagagagggttgttaaatattgcagtggattatgatatctttcactggagactttgaaaaaatgaacagtctcacgtttggttctgcccaaaggcaaagggacagactatgactgatgatctctagtaatctatgatttctttggcaatcaaatcatctgagagaaaaagtttattcttgatgattttgtcctttgtttcttaggggtggaatctcaataataatgatagtgatgaggtatgagagagtgagcagggaggagacatttggaaagaaaatgaaatgagaatatgaattcgcctacagaaatcaaatcaagccagcttcaatactccaaagtctgtcatgaccttctacaatgtcattaggaaaagcagaaacaagctcagctgtggtcaaaccaagctgccttttatcttcttatttttgctgttgagagtaatacataatatgtgcatattactgttactgttcttcaaaggagcattcttctagtcaattaaatgtgaagtttatatagtaaggattaaacaattacttcaggaaaatatcttcttactttgaaataaacttattacaaggatatagaaccaatcctgtgaaccctatagggtaggctcaaagtctttaaaacataattaagtcttttcattaaaaaaataacaagagactgggtgcagcagctcacacctgtaatcccagcactttgggaggctgaggcaggcggatcatatgaggtcaggagttcaagaccagcctggccaacatggcaaaaccctgtctctactaaaaattaaaaagttagccaggtgtggtggtgcatacctgtagtcccagctacttgggaggctgaggcaggacaatcacttgaacccaggaggcggaggttgcagtgagctgagactgcaccactgcactccagcctgggcaacacagcaagacactgtttcaaaaaataaaaaaaaataaaaaaataaaaactcagacatccatggaaaactggttttgtttaaaggtgagagaaggaaggaagatctttggaccacttaaaaattttttatttaatcaaaatttactgttatttttcactttttcttttgagacagggtcttactctgtcaaccaggctggaatgcagtggtgtgatcagggctcactgaagcctcgacctcctgggctcaagcaatcctcctgtcgtagcctcctgaatagctcggtccattggaaatgaggctttaaaaatactttgtaaatattctgtggtactaaaatgagtgttactagaagatcctaattgcctttatgctctaatttctccattattcgactgtgcaagaaatgctactggaaaaagtaatatccatttgcaatgaacaattttatcaatagatagattaatgggcagttttattgaggcttccttaaaaaaaaaaaaagtcttccaattcaaatatactgatcaccaaaaataagaaatgagagcaacttaaagggaaatggtttactaagccagttgcagcaagcccagacccaaatgttattttgttctaaataaataaatagtagaatatgaattacaggtgttttcaaccaaaatgaaccatttatattaaaatgacacatttttttctgtttctaggtgattaaataaatagcaaagaaaatcaagcaagagcccatgcgtgcacctgagactacttttgttaagcatttcgtgtatactgcataagaaggtaacagatcatgctagctgtattcctactaacgaaaaatttaagatgagaaaattaataatcggaatacttttggtcatggcaacagactaaattactatttttaaacatcttgccaatatattaaaacatatgctttttgaaaattgtttaactaaattttttttaggcaaagcaactaattttacatgttcaccaggctgtgagctatgtgagggcagggctggagctcattcatcttcatatcctgggggcgcaacacacagcaaagaatcagctcattagatgactacttttctgctacttcttccttcattccatcctatatagatctgccagattcatcttcctgaaatacaacttttatcatcagatcacctgtctgatctaatctgtctgatctgtctgaaatacaacttttaccatcagagcatgtgtctcatctggaaaagaagagctgaaaaatgacacaagggttcagagatacggaaaacagctctaaaaagatctaatatttatctaaagtgagtgttacaaagaagaaagtgacaataaggagaactgtaaaataaatacagtaattgaaggaaattttcctgaactaaaaacacttgtctttaaacttaattttaggctaaagctacttccttatatttaagtttgacctaaaggtttctccacacatagtgaagtataacctaaccagatttgtaaacaaactgtaacctactcttgcaggaatcagagttctggccaatcgcaggcagccaattgttcaaactgggttcaaatgaggcaaacaccacggtgtaaccaatcaggttgtttctgtacctcacttctgttttctgtgaatcagagaggatttcggtccatgaatcctctctgaccacacagcagcaccagagttgctctgaacctattatggttgggggaactgaattgttctttgctcaattaaattatgttgagtttgtttctcttttaacacacccaagatctcagaacagtctcattaagtgctaagcagattaatgagggggaaacagaccgtattcaggcacatctcattacaattcaaaactccaaagataagtgaaaaattctaaaagatttgggtcagaggtggaatgtaagtagaatatgacttattgatagtaatataggagaaaagtagacagcagaaaaaaggctttacatttctaagggagcatgatttagaagaacttggccagctaaactgttaaatatgtgtctgaacaaaatactgattatttttgaacaccccaaatctcagaaactttattacctgtgcctttcaagtgaaaactataacaattatgcaaggaagtatctcccagcctacaatattcccctcacaaaaaaccacagaagactcctagagaaatgaaatgtgatacaagaaatgtggatggctcaatatgatctagaagagatgaagaaaatgaaattttaaaaagatccactggatctagaggtggggcagggtctggtgaaaggttatatctgcttcttctccatccgcactgcagtgaatcatgtttatataatcataatactgcaaatgctatttttatgggacttggggaattaattacagctacagaatagaatgttataaactctgacaatatcaaaataacaatacactgaactaaaaccaagagttaggcttaaaggaaggtgggaggtagaagtactctaaattttccactctgaaattgatactgtatgagcctaagaaagcaagagctgaaaacatattattgaaggcttgggtcaccccaccaggtaaaaagccacgaccagctcagttgcttgctgaaggcaaagggaatacagaatgagtagtagaagaaggcagttatcaatactggctaaaaccatgtgtccagttacagaaaggaggactgtactatcatgagtaattcctccttattttaagaatatgcccgtacatggatatacctgtactcagaaaatatcttcgttttacttcctttcttcttcctttatcatgtaacatgagatttattgacttcatatcagcatttaaatgtcattaactttatataatagcatttaggttaaggattagggcattttcagttgtacaaaatatagttgtattatgttaggtgtaattatgaccttattgtttttatttggagattaagtatgatttaaggagatgtgtatggggctaagttgacaaggggtcaactattatggttcacattaggtgtcaacttgatcagattgagggatgcctagatggttgctaaggtattgttggctggcaggggtgagggtgttgccagaggagactgacatttgactgacatttgggctgggagagaaagacccaccaattggctgccagcgcggctagaacaaagcaagcgaagaaggtgggatgtaatggtaaccagtagaactaaagaatagaaaacagtaatagcacttacccctggaaagcaggactagggtaggagagaagagagagggacactcttgctctctattttagaatcttctttgaggttatgtattttctatcatgaacagatattactctaaaactaaaatgtgtaagaaaaagtgtgtgaaattctaatacacttgctataaatagagtatcttgtttactaaataattaagatatacaaagaggagtaataataaaaaagataatccactgtatccacaaactgacttgagaaataaagcattataaatgcaattgaagccttctgtatttttcttcgccaaccacatagtagatcaacttttaaaagaaaagaagcaaatctagatggacccttactattgtccctgctcatccacctaatcccactcctacttgctcctgaccattcctgattaagatattcagttgcaccaaataattgactcaggcaccttaacaaaatattaatatgacattagtaaaactcccaccgtgcccccttgttattcagactgtatgtcttataataaatacaagcttgctgtgctaagttttttctgggattaaaaaaaaaaaagtagcaaaagaacacagtaagtccagtgattgaggaaatgaaaaacaagatataaattgtcactacaatcatgctccctgcttctgcaagaccttgtgattcaattagtatgatttcaccttaagtgtttgtgtctgaggagctggtgatcctgaggcgctgtagatcctggggtctggagggttacacatgttagctctggagaaaacaataaaagcctaaataccttcccttaatttgagaggggttagcttactgagcttgtgaaatatgtggaaaccactatctaaccatttacaagctacctttttttttaataagctacttttaaagaggaggggtagcaagttggccatgtcttagaaccttggttatgaaaacttcattaatcagagacaagatttttaaatgtttaaaagaatatggctattaccctctttctcaccaagtcttttagaaaaataagatcaccctacccacacaccaccactaccaaatacctgactttaaggatacggctaatgctagttcttcaattgtaatttcctgagttatatatatatatatatggtgactgaattcatacctgaagcagccccatcctgataacacaataaaaaccaatgcttttcttgagacagggtctcactctgtcacccaggctagagtgcagtggcgcaatcatggctcactgcagccccgacctccgggctgaagtgatcctctctcttcagcccctcgaaagctgtgactacaggcacgtaccagcatacctggctaatttttgtatgttttgtaggggtagggtctctctatgttgcctaggctgctctcaaattcttaagactcaagcaatcctcccgcctcagcctcccaaagtgcagggattattggcgtgagccatcatgccaggccaaaactggtgcttttcaagctttaatgagggcacgaatcacctggacttcctgttaaatgcatacatagtctgattcagtacctctgggtggggcaagagagactgcatttctaacagtctcaggtgatactgatgctgcccagggagccacactttgagtaaaaggggaatccagtatcaatctccttcccaatctcctttgggtgtttttctttctcaattgctccatcttctgacatttgctcttttctaactaaatttactcccaagatgatctcatctatttccttcttttaaaaccatttacacaagccattctcaaccctgactgcatattaggatcaactagggagtcattttttcttcttcttttaaagttttctaaagccccaccccaaaccaattaaataaaaatctctggggctgggtcagaagcatacggattttgaaaagctccttagtgactctcatatgaagcgctaagaactgtggatctacacaacgatgtctcccagatctaacctcagctataacctctcccctgcgcaccaagggcctacttcacatctcctgttgaatatctaataggcatccacaaatcaacgtgtccaaaacagacctcttggtttccacctacccccatgaaaatctgatcctctaccagttttccccaatgttggtaaatagcccactgttcacctcgttgcttgggccaaaagactgggcttcaccatgatgcctccgttcccattctttcacattgcacatccacttaatgcatcagcaagtctgccagctttgacttcagaacaacccccagtcagtccacttctgacaatttctactgctaccagcccaagccagatcaacaccatctgtattgccactattaacaccctagcacctattatccacagtcttgcctgttaacctcagaacggctttccctcccacttgaaatacaaactccttcctgtggctcccaaggctttctatcatctggtcccggctaacctctctggctccctctccaattcttctcccatccctacatcctactcctgctacactggccttgttgttgcttcttgaccactccaggctcttccctgcctcaggatccttctcttacttttccttctgcttagaatattctttacaggcttattcctaatcatcattcaggtctctgctctaatgtcatctcagaaggcttccctgattatcccacaatagcctcaacccaaccagcacccaacacaacttcctcaccctgaactttctaccctgctcgttttcttcatgacatttatcatgactaggcaccgacccacccaaaaccactagaccataagctctaaaaaaactgtcttgttcaacagagaatcacaggcctatatccatacctgaggcaagttgtacacacttaatgcattttgcactatttgtatcttccctctccccccatcccccaattcataaattgaaaccctaaccagtgcgagagtatttggaggtgggacctttggaaggtaattaggtttggttagtatgagagtggaaccacaggggatgaggtcatggggtggaggtcccatgatgggattgctgcctttgtaagaaaagacacaagagagattcctttctcttcctttctgtccacatgcacataccaaggaaaggccatggagcacacagtaagaaggtggcaagccaggatgagaaccttcaccaagaacagattctgccagctccttgagcttggactttccagcgtccagaactgtgagaaataaatctctgttgtttatactccccagtcaggtattttgtcctagcagcccaagatccctaagacattggtgaaaggaataaacaagtcaatggggagcagcctggatggatctgtcatgtgccccccaagctctgggactgtccatcctttggaatatctagcattttcatcaataatttgaatgacggtacattagggcatatttaatttgccagtgacacaaacctgtaagtcatgctagctaccttacatgttcaataacagaaatatgattttagaatattttcatgggtgatcaattttaaccgaacaaaacaaatattaattttaactgaacaaaaccaatattaatatttactaagatgaacataaatgttgagggttttgtttggttttttttgagacagagtctcactctgtcacccaggttggagtgcactggcctaatcttggctcactgcaacctcagtttcccacgttcaagcgattctcctgcctcagcctcccaagtagctgagattacaggcatgcaccaccatgcctggctaatttttcatatttttagtagagacagggttttacatgttggctaggctggtctcgaactccctgcctcaggcaatccacccgcctcagcctcccaaagtgctgggatacaggcatgagccactgtacctggccaatttatatagttccttgattaaaaccacttgtgctgggcatggtagctaggattaaaggtgcatgttaccgtgcctggttaatttctgttgttgttgttgttgttgttgtaaagacagggtttcgctatgttgcccgggttggtcttgaactcctggcctccagtgatcctcctaccttggcattctttaggaggctgggattttggtgctgggattacagatgtaagccacctcccccagcctacaactcttcaaagcactgttggttacttatatttgatggataataagccatctttaagtacagcacttatatgtaattcaattattacaaagcaaataagggatggtatggcatcctgtgtcaaccctgcacacacagctgcctggtaaacagaagaatacctgtcattatggttttgcttatctttctgcccttcaatttcaaatttttcagaaaacatagatcatttttctaaagacttcctcagcttgtacactagagaatctttataatcacccacttgtaccaaaggggacatttttcattctctaattaaataagaagacaaataagcaaaggccaatacttgcaagaacagaaacaaagagctattataaaagtaagcattgaaattatccccacactgactttaatgagcacacaataaatttgtaaatgcaataaaaatatattaaatacacatgaaagaacattcgtaatcaattctgtatgtccacatcactgaaagaattagtctaaaagaactatgttagatgttagttttataattaggcacatttcaactatgtgttaactgtctgatctactaatttaaaataaaccattcaaatgtgtttaaatatctataatgctttcaagttgcttacatatatgtaaacaagtttccataaagtttagaggttaaaagatagaggaaagatcttatatgtaggtaacagatatagtttccttatatttgaatgaaaaccttacatatgtgtatgtatataatatatatatatatgctcacgttatacatacacatatatatgcatctcatatatgtgatagttaaaggccttggttctctcaggcaagatccttgagagtaaaaaagaactttttttggttgggcacggtggctcatgcctttggaagtctgaggtgagtggatcgtttggggtgaggagtttgagacgagcctggccaacatggtgaaaccctgtctctactaaaaatacaaaaattagctgggcatggtggtgggcacctgtaaccccaactactcaagaggctgaggcagaagaatcgcttgaacccaggaggtggagtttgcagtgagccgagattgcgccagcatgctccagcctgggagacagagtgagactctgtctcaaaaaagtaaacaaataaacaaaaaaaaaaaatttttttttaaataagcaactatgcttatttaaaaaaataagcaactatgcttatttaaaaaaataagcaactatgcttatttaaaaaaataagcattgttatgttttgaggcacagaatcacagggatttggggctaaaaaaccttaagaattatttagcccagcttcctcacatcaggacgaggaagtacattcaatgcccaaaagtcacacagctggttagcagcaaagccaagacttgggcccagacctgggtggacagggctctggaacacaggtactttggttctgacatactgtgggggcaagaggagtctgaaggtgatgaaaatgcaaatgcactgccccaaaacaggttagatgaggtataaactgggatctgaggtgccaaaatttatgggatttaggcctttctctcctgaatgtaaaaccagtccaatcaggcctagaccatgtatgcaataaatttgtgtttctttgctattccctaatgtctcagtcttttcccattcttagatgcacaatccattagatccagatcaacacaaactgctctcccccaaaatgggttgtactcttgaaaattactttgtagtatggaagagttttaggtaatatcaagttacttatttttcactgatagcttaatacaaatgtaaaactcctgccaaatgctggaagtccagggaaaaatacattgcatagtagaccctacccatgtgtgctaggcataataatggcccccaaagtagaccacaccccaatccctgaaccccatgaatctgttgccttacatggcaaaagggattttacagatggaaagattatcctggcttatccaggtgggcttactgtaatcacaagggcaattaaatcagggaactatcccagatgggttgagagtcagagggtaacatgactaagggagaatggtcacagagatgcaactttgctggctttgaagacaaaaggagaggaccacaagccaaaggatatttcttctacataaaaatgtaaataaggaaacattttgtccttagagccaccaaaaagtaacatagccctgcctacaccttgattttggcccagggagacctgtgttagacttctgacctacaaaagtataagttaataaaattactttgtagttttaagccattgaatttgttgtaatctgttacagcagcaagagaaaactaatacaaccatatgaaccaatatccaaaattctcatcctttggccagtctgaggttcaataccagacatagtaaccaataccagcaacagacatagccttgtatcatacctctctgaagaacttcccactctcttcaggttatatacggataacttcagtagaatggtgcacagcttgaaaacagaaaagaaggctcctgagagccccacgcaaagacaacactgcgcaaactttgagtaagttcaatttcactgtttattttagctcattctttgaactacatttgcttccaagtgaaacaaaatttactttgaataaattttgcagtgctctacttgaaacagctggttggacttttcaaaaagcatcttgtcagaattatgtattttttttcctaagacatattccacccactaagtcataccagaagccttggtaatcatggtggatggtgtgaacgcaaatcccttagatttccattctgcaacaagctttcttggaggaaggtgtgaatatatcaaacatcttagatgtaatgctaaagaaacctgcataaactttggccacatccactgcatggggacgtaagcagaaacaaaagaaaaaacttgtagttccagtgctgaacagccaaagccagaccatctgcgtgacagcaaaggctaaagaaacaaatgcagcaaaacgcaacccaggctttaactgattctttcctttccaatttctaatacagtatgtcccaacttgaaaagggattacccacgaagaataaagaggtatagaaaagaaaagaagagttaaactgaaaacctgtacagaaaaatgcacccaaaccggagagtctgaggactcgtgttccaagtcccgcttgtataaatactgatcctccacctcattgaattgttgacattacataattagccagttacaataataacactgtagcttaacacactgccacaaccggaggaattttaactactctagtgaattgcccctcaccagctacatctgtgctggtcttcaaagcaaaagtgcggaaagaaaagagatggccgtttagtatgcagactaacgcagagtaaacaaggggagtatggcctatccagcatttgggttcttggggttcccctacccgcttgttttttgtttttatttaattggtttggtctttggttgttgcctacttaagtaaataatattcagtaaaagcacttcatagacactgtgaaatcgttaaaaaaaattatatttatatcagattactgtgtacttgaaacaaactcacttattcttcaacttcataaacttcaatataaacaacaaaaaaagtaaacccaccacttttagacacttattctttaggctttttaactctaacataaacaaataagaaaatattgttaaatatccttagaaatcttgagcacctattagcattctcagcactagccggacgaagggtttgaagggtttcacctgccagcaaccctttcttttctctttactcacaaattcgctctagggaccagaggatgctgtattcttttcttagtaaaatagatgaaatctgaaatgtagcctaacccagacacagaaaaaccacatataaaattcgaatgttcttagacatactatacagtgagccgtgctgaaaataatagcctttctgtgtaatttatcctgtttttctcctcccttatttggtacctcagcttctcattcctcctaatctgatgtctcatacccaaaattcttttagccaacactcaccttgggaaagcctttttttttttttttttttttttgagacagagtcttgctctgttgcccaggctggagtgcagtggtgccacctcaattcactgcaacctccgccttccaggttcaagcgattctcctgcctcagcctcctgactagctgggactacaggctcatgccaccatacccagctaatttttgtattttttgtagagacggggtttcaccatgttggccaggatggtctcgatctcctgacctcatgatccacccgcctcagcctcccaaagtgctaggattacaggcgtgagccaccgcgccagccctgggaaagccttttaagtcctcactcctgaaggttaataaaatctttcaggtccccaaaatctgaggcatcatgatgatgatacctgagtgtgtaaaaatcctcccaacactccttcatctactttatgtggataattaatacattcatgtcaatttaattccttatcttgcccaattgttaaaatccattatctcctttactcctttggaactcttctaagattatgatgccagagaagagtggatactggcctgacaaaaatgttctgttatttatgtgcccaccactatgtaaatccccttatcctgctttatttctcttcatagtccttacagtccatcacatatccatctaacatatgatattctattagacacctctttgagtttttatttgtctctcccaccgaaatgaagagagaaaccatatttgttttatttactgctgtatcttcagggtctggagctatgcccagcacatagtaggcactcaatttttgttgcagaaataaatggagattttgtgacttaagtggaagaatggaatagaatatttgaaatggggactattccagaaaatccaaatatgcagttgccatacttagaccacatatccttgattcaatgcaatcaaattaataattttaaagttatttgtgttttactctataaatgaaaagataatacattactgcaactgatttgctaaaaatagctgacttttatatgcgaatcaggtaaaatacactcacaaaggagggtgacccaaaaatcactgagcagttgcttgtgcatgataacagagtgtaatacaattcatgtgtttcagcacatatataattaagaatgccaatatattttttcttttcaaagcattcttaatttcttaattgcctagaaaatttaaaacttcttacaaatattatgatgaaggttttgagggtatagaaactaaggtaacataaaccaacttctacagactaaagtaaaagagacattttattagtctctatcacagactaatttggggatttcagatccaaccttgctctaatatgacttataaaaggcttacgggaaatatggctggtttcactgttaatgattcccctctcctttcttccctctcttcatagcaggctttattgcaagaaaacttacaggaggcaaagtgttcaagtgtaaagaacgatacactgactatccagatatgagaataatttactctgtttccttgaagagattacaccacaaaatagataagttagtaggtaaagaactgctttcttccaaccaaaaaaaaaaggagaaaggtggtttttagtagttttagttttgccaaaactactgaagttgaagacttcccaaaactactaaaggaagactgaagtggaaggactgcttgaggctaggggtttgagacccggctgagcaacatagcagggcagggagttggggcggggtgcgggcatggtggttcatgcctgtaatcccagcagtttgggagtctaaggtgggaggatcacctgaggtcaggagttcgagaccagcctcgccaacatggcgaaactccatctctactacaaaaattagccaggcatggtggaaggcacctgtaatctcaactactagggaggctgaggctgggagattgcttgaacccaggaggcagaggttgcaaagagccgagattgcatcactgccctctagcctgggcaacagagcaagacttcgtctcagacaaagtctcgctcttgtccccaggctggagttcaatggcgtgatcctggctcactgcaacctccgcctcccgggttcaagtgattctcctggctcagcctcccgagtagctgggattacaagcacttgccaccatgcccagctaatttttgtatttttagtagagacagggtttcaccatgttggccaggctggtctcgaactcctaacctcaggtgatccacctgcctcagcttcccaaagtgctgggattacagacgtgagccaccatgcccagccaaaacaatttttttttaattagctgggtgtggtggtgtacaactgtagtctcagctacttgagggactgtggtgggaggactgcttgagcctaggagttccatgctacagtgagctatggctgtgccaccgcactgcagcctgagcaacagagtgagatgctgtctctttaaaaaaaaaaaaacaaaacaaaacagaacaaaaaaaactggaaaaaaaaagtcaacaagaagcaaatgtgttaggacacgactgcttgttggaagcctttgctaaaatactagaaatgtaggaaagagactttttatttctataaaatcatgaagtttatgagactacaaagataaagctgacagactgtctccatgagcagggctaacaggaagttttgtttgttttttaaagcagtaatagcttatgtcattcttttgcctaaatctgttacctgggatgtagcagtaaggaggctggaaggtgttcacaaacaatctttgaggactaatgcaaattcactcacatgaatgcatggactgctctgaaggtaccagacctcagggcactcccaccggcaggcttactgtgaaccgacatcccctacttctgaaatccatttggtacggcaggagatctcttgcgggatgtctgcattttcagaagaaattatctactgactgctttggccaatgtgctttttcacctctaaattttaaggtgtttttagctttatcagcaataccagagcacatcacacgtgcacacatccaaatagatctcagcttccacacttgaagattctagaaagccagatggcagggccatgaagcacatgtaaccaacatgggctgtgaagtcagtcagacccgggcttgcatccaggtggcttcacttcattgcaagctccttcacttccctgagtctcacaggaggatagctattcctttccttttgagccaaatttaacaatgtaatagtattctgaagagagctaaacctaaggacctttaaattcaatccacggagaccactaattaactatgagccactaaaaaggagatgccaatcacaggatgaggaaggctggtagagaaaagattcctgacttcctaattatctgaggtaagaaagttttgttttggggtatttatttatttattttttgcacactggctaagaatagaatatgccaaaacaaagtctgcactctagggtgtacaatctaaatcatatcttgattagcatcacctaaacctaaactggactaagcagtagaaaacagacagcagtgggcaagattacacttgcaagggattgtctgtgagataaacggttttatttcctgattccaactctaggtccctcaccttagttttcaaatagtgaagttacaggaccacgaggataaaagcctcctcattccagacgtcctgcaagtgtgatcaggggttatctgcttcctagaatggagtttccagtggaaaaggacaaggtttaataggagtgtcaagatttccttccctatatattaagatagttacctaaaaactgttgttctttcattttgttcaatcatcccacaaatatttattaggtccctaccacatgccaagcactgtgctaaacattgaggataaaatgaatgaacaaggcagatacggcctctgcaatctgggatcccacacctgaatgcagggagaacagccaagagagaaacagcggtgggaggcagtgatagcctgccgctacaagcctcacacaattgatgaatactagacatagcaaggaaaagggaagaattctaaaattttgcaagtgagctgcagtctgagctgatctctttagctgcccagaaaaaacaaaacaaacaaacaaacaaaaaacccacaaaacattactcacagggagcattattcttttcttttaaggaagtattttagttgttgaaaagggataactaactgctacacccacaaagctggcatggataggaaagtgagataaagaaaggtgaaggcctagggtaccgagaaagtgggtgtagtttcaggttgggagtggagggagataagctgactacagtcacagccacaagcctgaggaggttttcagacccataggaacttgaactatgttctaattccacctcctttactccccagtcttcagaagagtctgtgctaataacagctttgggtaaataaagctttgagaaatgaaggagagggaaattttctctgcttgaggcaatgagatccgagagggggcagcaatcatgggtggagagaactacacagcgtaatcaagaatcaaatggggaggcaggattccaagactagagaccagaaaagtgcctgtcataagcttattcgcacataccttcacccatacactctccaccgcctgcttcctccccaggaatcctcagaaacacttaggacagtagacctcccaaaatacatgtgatggggactggagtcattttatttgactagtaaggaaagagtgtcacctagatgaaagatttaaagatctgcaggttatatagaaaaattagtgcaagtaaaggaatgataacttctccagcaagagcgatgactgccctattttctaaatagagagtatggtagctttaaggagagtggtagctggaaaatgcctggacttattgttaacaaattttgggggcaatgaaataatctgtataacaaaccccatgacacatgtttacctatgtaacccgcacatactgcacatgtacccatgaacttaaaagttaaaaaaaaaacgaatttatttgggcagtataggtatcccactttataaaactggtattatttctcagagactaactataaaacacttatttctatcaaatcccctattttctttctgattccattataaaacatcctgttccttcaggtgcaaaaaatagaattacactattataaaaggaccctttaagttgacttatgttgttttagaaaataccaatgttagcaataaaatttctacagatacaaacattttgactattaaaagtcaagaaaataaactgaacttaaaggagagattcccatcatatcaataaggaatctctcctttaagttcagtttatagcaccatccccattacaagtcatattaagatccgggcgtggtggctcatgcctgtaatcccagcactttgggaggctgaggcaggcggatcacgaggtcaggagatcgagaccatcctggctaacacggtgaaaccccatctctactaaaaatacaaaaaaaaaaaaaattagcggggcgtggtggcgggtgactgtggtcccagctacttgggaggctgaggcaggagaatggtgcgaagccaggaggcggggcttgcagtgagcgaagatggcaccactgcactccagcctggggacagagcgaggctccatcgcaaaaaaaaaaaaatgaaaaagaaaaaaagaaaagattctctttaaaacctcaaggcttctattttacacaaaaatactctttttgctaactcttaaattattagagcaacctgcaactcttttcctagtttctggttaaaagatttaaattagcttgcttatatagtgtacacacgtatatatgtatgtatgtgctgactgattgaaacagggtctcaccgtgtcacccaggctagagcgcagtggtgtaatcttggctcattgcagcctcccaggctcaagtgatcctcccatctcaagccttctgagtagctgagactaagatgcacgtcaccatgcttggctaattttttaactttttgtggagatggggtctctatattacccaagctagtctcaaactcttgggctcaagcaatcctgactcagtctcccaaagtgctgggattacaggcatgagccatcacacccagactacagtatattttctttacaacgaatttctgtgtgtgtgtgtgtgtgtgtgtgtgtgtgtgtgtgtgtgtgtgtgtgtgtagttgacaagcaactttttaagcttattccctttttcactagaataatctccaataacaacaaagtaataaaagtctgattaaagacaaattatctgaccaggcaactgcaatctataaattagttcagcaagctaatgtcagatgtaaaaagttaccagtaaaaggaagtaagtgtgctttggaacaaacagggaggatattgtttgtgttgggttgaacaacacgttgtccatccccctgcaaattcatatctagctggtacctcagaatgcagccttattagaaatagggtctagggtcttcgcagatggaatccgcaaagttaaaatgaggtcatgctggatttgtgtggaccctaaatccaatgcctgatgaaggccatgtgaaaacacagagacatcagagtgaagaaggctgggtggtgagaggcagacgaaatgatgcaggcacaagcctaggaatgccaaggactgctggcaaccaccgaaaactaggaagaaagaagaagggattcttcctagagccttcagagagtgcatggccctgctaacaccttgatttcagacttccagcctccagaactgagagagaataaatttctgttgttttaatctacaaagtttttggtaatttgttacagcacccctaggaaactcatacagaatctttgaccaaaaggcatgattggtgaaaaacaactttcccgtggcccattcattcttaaagtgaaatactaatgcagcaaagatacatagtactagtgcaaattcctacttcatactaacaaccacacaatctttacatttccttcatcactctcactgtaaacaatagtgtccacaaatccaggcagctctgtgcaccctggactgctggaaggttgaagcaaaacctaactgtaaaaccgaaaggccctgtatacagcttgttactctaatactataaccattaagaaacgatacactgcttttctctaattatttctgaaaccctccccttatttacagtataaaagctaatgaaaatgtacttgtgatcgttgtaattcactgaaaatctgacaggaaaaaagcccacatgtaaaaacatcgacacactcaaaatctttaaagctttctggcttatgtaacaatttcaacctgtatacggcagttcaataaattctaaatgaaaagctttatgcagaagtggccaaaattggcaaaataatttcttccatactccctctatcaatttggtgcgtgtgcttcaagctttcagcaaggagtgttaaacacatgctcttctcttctataatattttggtggttgcgtcactaagaaaatagtttatcaatgtaccacttgtaactgactttttcaatggaattatgtagttacctcaacctcttcaaaaagataaatatagtgcaaaagcaaaaaacaacaagaagaaaaaaagaaaatgaaaacttccagggatacaatttaactgtctcattcttgtagaaaaaagatagtttgggcttaaatagttattctgaagagattcttgtcagttcaagtagaagcttttgtaaatgtctaaaatgaagcacattgtggttctcacaattctatttccgttgatgcaaaagtgaatatttaccacaataagcaaacacaataccatttcccaaaacacttaaattcagaaaaaactatctgcaattagtcaactatgtcataaagcaggcagcacctcgtgctgacattttgctgttattttagtcccattaaaacactttttaaaaaatatctggtattctattttgaccagtcccacatggggccaagactggcagaagtcatggtaggttagcatgagttttcttactcctcatcacagctctggaggtgaaaagccagaacaagatccatgccagggcaggaaagaactacatgtgaaaagaaagcaggtacactgttgctttcctctccccaggactcctctacagatctttcaaatcataaagtttctgttgccacggctatcagtgcaataccacaggttaaaaataaaaccagtggtggcctatgctgttagagaaagttgggtgcataggaaaagacaagctttgggaccaggcaggcgtgggctcctatttctgacccactgctggttagctgcgtgctcttgggcaagttgctcgaatccccaaagtttaatttcttcattcaagggttgtaaggctgaagggagatcaagtatgaaaagcacctaatgctactcaagtctactacactcaataaatgttacctccttttcaaatgaaattatatcaagcactctctcagaccacagtggaataaaactggaaatcaactccaaaaggaaccttcaaaaccatgcaaatacatggaaattaaataacctgctcctgaatcattgggtcaaaaatgaaatcaagatgaaaatttaaaaattattctaactgagtgacaatagtgacacaaactatcaaaacctatgggacacagcaaaaggcagtgccaagaggaaagttcatagccctaaacgcctacatcaaaaagtctgaaacagcacagacattctaaggtcacacctcaaggaaccggagaaacaagaacaaaccaaacctgaacccagcaaaagaaaggaaataaccaagatcagagcagaagcaaatgaaattgaaacaaacaaaaaatacaaaagataaatgaaacaaaaagctggttctttgaaaagataaatcaaattgatagaccattagcaagattaacaaagaaaagaagagagaaaatccaaataagctcaataagaaacaaaacgagagacattacaactgacaacacagaaatacaaaagatcattcgaggttactatgaacacctttacatgcataaactagaaaacctagaggagatggataaatttctagagagatacaaccctcctagcttaatcaggaagaattagataccctgaacagacaaataacaagcagagagactgaaatggtcattttaaaattaccaaaaaaaaaaaagtccagtaccagatggattcacagcagaattctaccagacattcaaagaagaattgatcccagtcctattgacactattccgcaagacagagaaagagggaaccctccctaaatcattctatgaagccagcatcaccctaataccaaaaccaggaaaggatataaccaaaaaagaaaactacagaccaatatccctgatgaacacagatgctaaaatccttaacaaaggactagctaaccaaatccaacaacatatcaagaagataatccaccatgatcaagtgggtttcataaaagggatgcaggtatggtttaacacacacaagtcaataaatgtgatacaccacataaacagaattaaaaacaaaaatcacatcatcatctcaatagatgcagaaaaagcattcgacaaaatccagcatccctttacgattaaaactctgggcaaaattgccttacaagggacatacctcaatgtaataaaagccatctatgacaaacccacagccaacataatactaaatggggaaaagttgaaataattccctctgagaactggaacaagacaaggatgcccaccgtcaccactcctcttcaacatacaaaattaatgtacgcagatcagtagctcttctatataccaacagcgacccagctgataatcaaatcaagaactcaatcccttttacaatagctgcaaaaaaaaaaaaaaaaaccttaggaatatacctaaccaaggaagtgaaagacctctaccagggaaactacaaaacgctgctaaaagaaatcatagatgacacaaacaaatggaaacacatcccatgctcatgactgagtagaatcaatattgtgaaaatgaccatacagccaaaagcaatctacaaattcaatgcaatccccatcaaaataccatcattattctttgaggaattagaaaaaacaattctataattcatgtggaaccaaaaaagaaccaataaagccaaagcaagactaagcaaaaagaacaaatctggaggcatcacattacctgacttcaaactatactaaagccatagtcaccacaatagcatggtactggtataaaaatagccacatagaccaatggaacagaatagagaacccagaaataaacccaaatccttatagccaactgatcttcgacaaggcaaacaaaaacaaagtgggggagaaaagcctttttcaacaaatggtgctgtgataattggctggccacaggtaggagaatgaaaatggatcctcacctctcaccttatacacaaatcaactcaagatggattaaggacttaaatctaagatgtgaaactataaaaattcttgaagataacactggaaaaaaaacccttctagacattggcttaggcaaggatttcatgaccaagaacccaaaagcaaataccataaaaacaaagattaaatagctgggacttaattatactaaagagcttttgcacagcaaaagaaacagtcagcagagtaaacagacaacccacagagtgggagaaaatcttcacagtctatacatctgacaaaggactaatatccagaatctacaatgaactcaaacaaatcaacaagaaaaaaacaatctcatcaaaaagtgggctcaggacatgaatagacagttcgcaaaagaagatatacaaatggccaacaaacatatgaaaaaaatgctgaacatcactaatgatcagggaaatgcaaacatgaatagacagttcgcaaaagaagatatacaaatggccaacaaacatatgaaaaaaatgctgaacatcactaatgatcagggaaatgcaaatgaaaaccataatgcgataccaccttattcctgcaagaatggccacaatcaaaaaatcaaaaaatagtagatgctggcatggctgcagtgaacaaggaacacttctacactgctgatgggaatgtaaactagtacaaccactatggaaaacagcgtggagattccttaaagaactaaaagtagaattaccatttgatccagcaatcccactactgggtatctacccaaaggaaaagaagtcattatatgaaaaagatacttgaacacacgtttacagcagcacaattcgcaattgcaaaaacgtgaaaccaacccaaatagccatcaacaaatggataaagaagctgtttcatatatatatacatatatgtttcttttatatatatatgatatatatgtgatatatatatcatatagatgtgatatatatatcatatagatgtgatatatatatcatatatatgtgatatgtttcttttatatatatatcatatatatgtgatatatatatatatgatggaatactactcagccataaaaaggaataaattaatggcatttgcagcaacctggatgagactggatactattattctaagtgaagtaactcaggaatgaaaaaccaaacattgtatgttctcacttataagtgggagctaagctatgaggattcaaaggcataagaatgacacaatggactttggggactcagggggaaagagtgggaagggagtgagggataatagaccacaaatagagctcagtgcatactgcccaagtgatgggtgtccaaaatctcacaaatcaccactaaagaactcacttatgtaaccaaacaccatccattccccaataacctatggaaatagtgaatgaatgaatgaatgttagctccttttccttttctcctccttcccccaggtaagtttaggtttaaattttaactttcagcagaaaagctgcagatgtgttagcttccaacagacaatgcacaaggactccacccccagagagttatttgggggatatttattcttttaaacataaataagtgcctgcagctattccagggctgttatgttttacttcagtatatacagatattaagtctgcaagttaaaactgtcattccaaaattgttccctctaggacaaataaatagacatttaccccgttactaaggatgctacggcttattgtaatggctgagtaattattacagtgcaggtcctgtcagggaacacatcactcactatgtataataaggaggtaaggtctcaccacatagctctgccagtcacctgaaggaaaggtccctcagcctgggaactgcaactgaatatgagttttctatttagaagttaacactcagtgatgaaaacagatagagtctacgagccttgggaataaattagctgttaacttcaaaatctgaacaaaagggactgtttcaggtttatgtttctttgttactgttactggtattcttttcctgctttttccctccttagatatttggtaaagtcttttctcagctgtactaagacaatctcaaggatagagtctttttttcatgtttgtgccagacttgtaaaaaggggctagcctactaccttcgtagtcagcatgaaatatgctggaaaactaccaagagaacatcccaacattttttttagaaaacagagacagagacacatactcagagtgtatgaagttcaggtagtcgtcatctaaaaatttttctagacagtactaaaattgcatgagtgtctgttttaggctttttgtactataaaataaagcatataaaactgcacaaaaccaagatgtgcagttcaagtatttgtcacaaagggaaacactcatggaacaaccaccaggacaagacacagagtttgccagaacctagaagtgtgccttatgaccttactagtaactaccctctccctttcccaaaatgcaaccacaatcatggcttttgcctaagtatgcatccttagacactctggttttgttttgccttttaaaatgttatttaaatggatcatgcaggctgtattcttttgtgtctggcttcttttgatctatattatatttgtgaaatttatccatatgattacgtgtgtcagtttattacttttcattgaagcatactattccactatacaaatataaaacattttatccatctaatcttggtgaacacttgagctctttccaggtgttagttattatgaatgatgctattatgaatgttcttgaatgtgtctgttgtttgcatttctgttaagtgtattctaaggagtgaaactgctagatcatagggtatgcatttcataaactgttgtaccagtctcccaaagtgattgtatcaatgcatgttccctaccagctgcatgatcctgctgcctcacatctctgccacactttgtgggtatagtggttttgtctctcatctgtaacaaatgacattgagcaccttttcaaaagactatttatcatatgttttaactctcatacatatattttaaaacccaagaagacattgatgttgttttgtatggtcattaggtatttagatttttccacacagtcacatttatagttgcatttttgatctttcatctgagataatttttatcctgcctaaataacatactttaacatttcctttagctaaagtctgtttgttggtatcaaaattttccagtttggctgaaaatgtctttatttcactctcatacttgaagaatatggttgttgggtatagaactccaggttgacaactatttactttctagatattaaagatgttgttccattgccttctgctggctactgtttcttctaagaagtcagctactactactggttataattatacctcctaggaaaatttgtctttttccccccactctggttgctttcaagattttatctttgtttctgcttttattagcattacagtgatatgtctaggtatgagtttcttttttatttatcattcttggagttcacaggatttcttgagtttgtaaatagaagttatttatcagtgttacaaagttcccagccattttctattcaaatactgcggtgctccactttagtgctcatctacttctgagattccatttacaagtatttagaaatctcgtaccatatcctttaggtctcttaacctttcttctatattttccagtccttttcttctccatattttcttttacatattttctttcagctctttttcagtgtgttaatcttttctttagttgtatctgatttgttataaacctatgtagtgagttgtttattttggttataataatgtgcagttctagaatttgcactgttgtcttttatactcacaagttctcttgaatttttgtctttgcttgaaaacagtaagcacaattattttatttttattcttttaattttttttagacagagtctcactttgttgcccaggctggagtgcagtggtgcaatctcggctcactgcaacctccacctccccagttcagtttacaggtgtgcaccattatgaccaggtaatttttatatttttagtagagacaggtttttgccatgttggccaggctggtctagaactcctgacctcaggtgacccactcacctttggcctcccaaagtgttgagattacaggagtgagccaccacgcccagcgaacacaataattataaagtctatttctataatgccaatctatgaagctttaatgtatttttttctattgctattgtttccctagtttttgctgatattttcttcctacttcaagtgtgtgtttacagtaagtcctcacttaacatcatcaacaggttcttggaaactgtggctttaagtaaaacaccataaaattaagccaattttttcttatcaacattacaatgaaacacattgaacaaaacaatgttattcaaggacctgctatatgtgtcatttcacttaaaatcagtttctgagaacctatagacaatgttaggtaacgatgtactatattttttatggtgtgctactgcttttgcaaaactgttagtagaagtaatttgagaactaggatattattaacatattcttccagggaatttaaacttgttcccgccagatcttgtgggactagtactgtagaatcaccttaatctaatttcagggcatgagaaaattagaagctggacttcctttcttcccaattttggacccataattctttactatgttataacctctccaatgcctccaagcagacttttttatactttatcttgcttttctagtctccttcatcaggaatgttaatccaaattacttgctctaccattacagaaagctcctggccctatgtttcattttaataagctgttcctttactatatcaccttaaaccctataacttaatctatgaagtaggtctattattgctttagttttatccaataagacatgttaatctctatttttaagtctgttaattagttttgcctatttaaaaaataatgaataaaaaagcactcaaaaaagtaacagaaaaggtcatccttaattctattactttaatttattattattattttttgagacattgtctcactctttcatccaggctggagagcagtggcactatctcagctcactacaacttccacctcctgggttcaagcaattatcctgcctcagcctcccgagtagctgggattacaggtgcctgctaccatgtctaatttttgtatttttagtaaagatggggtttcaccatgttggctagtccgctcttgagctcctgacctcaggtgatccacgtgcctcagccacccaaagtgctaggattatagacatgaggcaccacgcccagccaattctataacttttatttttacttataaaaaagcccacccagcagggcgcagaggcttacgactgtaatcccagcactttggaaggccagggcaggtggatcacctgaggtcaggagttcaaaaaccagcctggccaacattgtgaaaccccgtctctactaaaaacacaaaaattagccagtcgtggtggtgcccctgtaatcccagctactcaggaggctgaggcaggagaatcgcttgaacccaggaggcagacgttacagtgagccaagattgcgccactgtactccagcctgggcgacaaaagcaagactctgtctcaaaaaaaaaaaaaaagcccaccttagaataattgtgtttgttgttatatgtcttataaaacaaattgtgtacagaatgatgtaataaccctttcataagtataaacttactgacacttttttttataaaatcacaaattcaaagacctgatactactacaactaataaatgatgaaatttcttcagcgctttttggttagaataatattatattatatccctttaaaatactactaaaagtggactccagattataataagactctgatcaagataaaatacacaaagtttcaactgttttctttgctgtataagaaaactgtggttcatacacttgctcagactgccaaatacaaagtgacccctcaaaattagaatgttctcctttaaatgtagaaatgtaaaggcttcataatactattgtgctttaagaaaaatcaattggtccaaattattgcatctaatgagattttccaggctttctggcaatatttgtgagttggagaaaaaggcaaattgccttatggaaacatctgaaacaaggtcctctgtctccatcttcatttgctttccataatcacaaattggttttcaggttactgtggctttcaacactttaaaccacaaatgaaggcctaattcttagcatactggcacaatgaatacttttaacatccccagttatattaatattagtgttctccttctgtactgcaaacagtctacaaatagagtgttaaatcagcagattcttcatgcttaatatgctgtaattttccataggactagtcaatataaatgtatactttaaaatatacacatttgtgaatgtccacaaaatacatatacttgtttttgctttttatattatgctaaatatagtatatatgtattaatacatgcatcctgatttgtatattttgaaacatatttacattattagaaataatgcattctctatggaaatacatcaaatgaacttttttagagcatctaatttgtataaatctttacacatgtatacataagtatattaagcaaaacgattactaaagagaataaataaaaagaaattacacctagacatattatcataaaattgcagaacatcaaagacaaagagaagactttacaagagaaaaaagagaatctaacaaagaaataacaattaggctgaaaacagacttcaacggaaacaatagaggccaatggtttgtggaaatatctttaaagtgctgagagaaaatacatcagtctagacttaaaacaagaacaagagaaaaataatgacctgtgtagaaagataaaaactgagaggatttattaccagcaggattttgcccactggagcttctaaaggaatactttaaggacaatacttctagaaagcaggtctgagttgtaagaaggaaaaggaagcaaataaattggtaaaatagtggcaaacctaaacaatcaataatacaataataaagtctagggttttaaaagggcagcatgtaaagtaggagagaagcaactggagttgtatttgaagatcctcatggtatttgggaggcatttaatatcaggtttagactgctgggtatgcatggacaatttcaaaggtacccataaactaataaaaacagtgtacaatttctacgtttagaaaaacattagctgctgttacaaacccccagatttcagtggcttaacacatcattctcataacagtctaatgtttggttggcaggtggttttcctctacacagacgttcaaagactcgggttcttaccatcttgtggcttcaccaaccattagggtcttataatcttgtgcatccagagagcagaagtgaaaaggggcatggatgaggtccaagcactccctaaaagccttggccccaacatggtaaaagtcacttctgttcacatcccactggttagatctcagtcacacagtatgtataacagcaaatggtcctggaaaatgtggcttagtgaatgcgcaaaaaaaaaaaaataaataaataacagaggagactaatacatttttgagagcagctaggaggttctgtcacagcttccaatccactgggaataagaaaacaaacaaaattcaaacaatttaaaaagaaagacaataaaagagaaagcgaaatggataaaaaggtgtgacaaatataaataaaatattaaggtaaggtgacagtaacaacatcaaacattcagcaagcacgacacatgtaaattaatctaccagttaaaaattagatattataatgtattttaaaacaataacaaaatgaagcagtatgctctttataagaggcacacctaaaacataaagacataaaagatcgacatcatgagaaaatattccaggcaaatatgaacctaaataaagttatgtactacatcagtatcattttaaaatggactccatccaaaaaaaaggaataaagagagtacctacacaacggtaaatttaacaggaaagtatactaattccatatatttaaatatctattaaaatagcctcaaatatgtatagagcaatatttaataaaaacacagaagaaattaatgaacccatcatatagtcagagattctaaaatatgtttgatgcagaggacatgtgtagtaatgccaaataaaagtacacactgttttcacatacatatttccaaaacctgtttatatgttaagccacaaaaccagtctcaatggagttccaacaataggtattatatagaccatgcccgttaatcacaatgcaattaagttaaaaatcaattatataaaaataaaatctccacagttagaaaattttaaagcatttctaaataacccatgagtcaaagtaaacactagaaaataaatatttacttcagaaaaaagaagtatttacttcagtaagaatgaaccacagctcacaacagggatgaatcagaaacataatgtgaggaaaaaaacaagtttcataacttacatataccttacataatctttcatatgtatcatatgtattactatgtgatacactggcacatatatttgtgaacagttcaactacgtgctccctttaccatttaaaaatctttctacttaacagaaagttccacggctattcactcttctcttcccaatcacagattaggaagatactttagataccagagtagtctggtgagacaggtatatcagattccagaataattagtccatcccaactgagatgagtaaactggtaagtttctagagcttaatgggtcagaacagctatgaggtccctgtctagaatacttggccctttcaaagtaaaatgacagcagtaagagaacagaagtcttcagtgtgctctcgagccagtcagacacaatgtcagttaaataaattttaaaaacacaacaggattccaaatataaagaaattaagatggcaaacaataatacagtattgtcaccatttctgattactggcaatttgaaaaaaaccttttctatgataaaatttaaaatatacgatcaatatttttaaaattaacatctttaaaaggattaaatttagtgaaaagtagcaggaacaatgaaatttggaattaaagtttctatcagaaaaacaccacggcctctccatctactgccagagctggctttaacaattgacgaatacttattctgcagggaatttgttgatgcaaaaccaggaaacaatttatctccactgggaatactttgaagaagggattagagcggggctagggcagggaggatctgtaaaaaacaatatttgccaaactaaaaacacataggcacacatgggaattattttactttcaacaagttctgaaagtagtaacaaaaccagggagagttaaaagaataatttaacactgatgtttcaggaatgctaaaggagaccaggcatttagacttcatgttgctaagtgtgttcatctcaaatctaaaagccactttcataacaacaactttgctattccttagcattttgtctctttaggcagcttatttcccagtcaaagttataattttgtattcataataccataatcatttccatggtaacttcctgtgaagtcacagagaaaacactattgacttctcctgaggctctgatttcccagttgaaatcatatgttgattttattttttccaatgtaagtcaaagatttactattaaaaatcctggggatgaggtcttaacacagaaaacccatctgtcgtcgctacagaggcaagtagagaaacctagtagcacaggatacttggtccaaactgcaaggacctgtaccaggagtcagtgaacttgggttcacaccccagctctgacagctatgagagaggagtctttggacacagtatctaatgttctcaagtttccctttacccatctgcaaaatgaaaaagtatctcataatgttgtgagaattaaatgagagacaatgctgtcagcttaaaaaaaaaaaatctcactcccccaaatttacagttatctctgacctcaggatatagatactgagttgcaatggaagtacttattcagcaaatatttattaagggcctacttcgtgttcttggtgccgggaagacaaggaatagtgttagtgctttggccctaacataaactgtttctttatcctgatgcttcagtttaatgtttacctccctccgtaggaggctagttcttggtatgaggtcaaccttgactctcagccctctctatttttctcttgtgcccacatatcaaggcaaatagagtacaaattttaaagcctcaaacagtgagcctctgtggatgagaaatgaagtccaggctgggcagcactgtttcaatttaccatctcatctgaaggaggggatgtggttccttttaaaggacaatgtataatgaataaaaaccttcagcttacagctagcttataattagtatttgggttaataacacagtgacaattgtctgaacctctgaaaacacaagggtagtaaatacctaccttcagaaaccaaagcatcagttaattccaagcctgcctccctatttctacagaaataacacaataattttacctagcaacttcaagaaaagtggagaaatagcttatgacaaaaagaaaacctaacccctttgaatcccttagatatgttgttgtcatcagatacttaaactttgtacctaaagtaaagcttaataaatttaccattataaatgttgaggtggtcttcaataaaagaaactttaaaaaactggcaattgtgtgctttctgagcaggaaaacaatttaaaatgtatatatctaaaggaagaagacatagcattctgtatctagatagcaatgtatatcctcctgaacactatttgggatagacagctcttggagaaaaaaaggtctatggtaagcatggaagggctctgagaagttctgcagcaaagaaacctgtttattgttaagaaaatgctaaacaagcattttccaaaattatttgaccaaacgtctcacagaaaacacttaagaacatgctgttatttagtaagccacacattcacatagctgctaaagtgtatcacagagtatcaactcataactcaaagcatcttgctctttgtagttgaaagagcaaataaaaatatcccagaactggccaagcacggtggcttatgcctgtaatcccagcactttgggaggctgagattggtggatcgcttgaatccaggagttccagaccagcctgggcaacatggtgaaaccccacctctaccaaaaatacaaaaattagccaggcacggtggtgtgcgcctgtaatcccagctacttggaaggctgaagtgggaggatggtttgagcctgggaggcagaggttgcagtgagctgagatggcaccattgcactccagcctgggcaacagagccagaccctgtctcaagaaaaaaaaaaaaaaatcctggaattctgttctaattgctctgcaatccctaccagaaacaagaatttccttctgtaagtgtatggaatatttaaatgatagaaaagaatgtaagctgttttgcttgtttggttgaagatacacttatacctagaacagtatctggtacacaaaaataactgtgaaacgaatgactgaataatctccgtagttttcttatcttctcttccatactccctacaagatactagagatctgtgattctacaaaattatgtatttagaagcacattacagaaaataacgcagacactggtactaaacagatagggttttaaagtctggttgcactactaattagctatgtgaccttcagcaattactttttacaaaacgggaataaactttttatcccacaggactactatgaagaaagcgcctggcataatcttggcacatcgaaggcattcaaaaaataccagtcgtctctcttcactccctctaactctaactcattttaacctcatttaaactttgaggaaaaagaactcaagggtaagtaaaacttcctggtggattatcaaatgagatgaggtaaaccaaaacaaacaaatcccacagagaatatgatgaaaacagagttactttctaaagactgcagcactgttcctcaggtgcttcccaaaggttccgagtactgtagtttacgtttcaggtgtgcatcttcttttaatcaaactaattcaatgaatttccagcacctcatttcattcaatcatcctattctctgtcaaaggttttatctccctcaaaatcaaaacaacatatttttataataatgtctctttctcccaacactcaaacaaaaaacttaaaccaagtttaacactccacatatattagaaacagcatgaagtaatgaagtagagtattcaatacacaattagtttacagaaattacactaactcttacctggttatcacatatattaccttctctttttttttttttttttttgagacggagtctcattttgtcgccaggctggagtgcagtggcgtgatcttggctcactgcaatctctgcctcctgggtttgagtgattcacctacctcagccccctgagtagctgggactacaggcatgcactaccacgcccggctaattttttgtattttagtagagacggggtttcaccactttggccaagatggtctcgatctcctgacctcgtgatccacccgcctcggcctcccaaagcattgggattacaggcgtgagccactgagccccggccaccttctccttttgaagagtctgagctcatattttatcttgtttctgacatttgaaaaaaaaaattctaatattaagaagctgcttgctgatttttaaaaaggcttcacgagaggactgaagtttctttttctgggtcaatcagtcattagtaaactaaggaaaaggaggaatcatacattaaaagggaaatttactagcaacatgcagtggagttacctgatgtgctgacagagtaacaagggagtgaagggaaatagcttcattaaatgaactatttatgttccagtaaatccagtgttttaaaattctgacatttgttttgaaaccagattcagattttgtacatagtatttctttgttggcaagagctggaagaaagttaatgccaataagtctagcttttttgcatatgctttttgtgtgttagggtatcagaggacctatgaatcaggtcaaaattaacaccacatgtgtatgtctttggagaaacagaaatgacttgtcagatttctatcataaaaactaatttatatttttgtaatcccactgataaggtagtaataagcatggcaactctcccaagtgctatctcttttatattaataactgattttgtaaaaataagatcaaatcaccaaaaactgcaggccaatttccaggcatgtcaacatactgcctgccctgaactccagagcacagtgcagcactgagcatatccttcttgggttcttttttcccatttgctctcattaaagtgttgacaaatacgcacctgtcagaaaatcttcagcatattttttcactctggaaggagcccaatgaatgacgttagcaggactaataaatttctctttccctttcttgaaatttaccaacgtaccataccaacacaatgaaatttttctgactcaaggaaagcaaaagagaccccaggaatatttaaagaatttctcaaccacagatatagacatgtacaaaacccatatcctgacttgagaaaacaaacatgtatccaaaggagatttcaaatccttggcaaaaatagcctatgaaaaaagcaatttttggctcattggggacatttacattttgggccttttacaactggttctctccttcactgctaacatcacaaaaacaatatattcatatttttaactgatagttttaaatggaatacatagtgataaaactggggaacacagcaaatgcaaacattagtgacaaagaaaagtctctttcaagatcaataatttcaaggattttagaacagtggtgctaaagagcatctcttgcatatcacaactctcaagagaacattaggaaaatatgataaaacctatggaatcttcactgctataaatgacagcacttctaaatatttgaaaatgatatcttagcatgccacacatgattcaatctaaaatggatatttgaagtcccactggattcatccccctttgcaatcatttagtgacccacgcccacctaggagtttgccagcactgccctagagtctaatatccattcaaggggctgggggaaggggggtggttcacacccataattccagtactttgggaagccaaggtgggaggatggcttgaagccaggagtttgaaaccagcctatgcaacatggtgagactccgtctccataaaaaatttttaaaaattatataaaaacaaaaaaagtccatcaagggattcactttaaataagtgaagtcaagaaacatttgggacaagtgcttattatgtgcagtgttcatcactgctgctacaaagataaattatacagagaatccctgccccaagctaacaggataccttgggtgcatcaaaggtctaacctttatagggtgcacagaggaaaacacacaagccatgggagacataagaaaatgacatgtagcgttgcattcattttaccagtgggaaataaagaaccaataaggtcaatgacaaaatgaatagagaattatctattataaaaagaaagaggccaggttcagtggctcatgcctgtaattctagcactttgggaggcagaactgggatcacttgaagccaagagttcaatactggcatgaacaacatagtaagaccccatttctcttttttttttgagacagggtttcactcgtcacccaggctggagtgcaatagcatgattgtagctcactgcagccttgatctcccaggctcaagctatcctcccacctcagcctcccaaatagcggggctacaagtgggtgctaccatgcctggctaacttttttctctaaagcagagacaaggttttgctaggttgcgcaggctggtctcaaactcctaagctcaagcaatcctcctgcctcagcctcccaacaggctgggataataagagcctggccaaaagacgccacctctacaaaaaataaaagaattagtcaggcatggtggcatgctcctgtactcctagttacttgggaagctaaggcaagagggtcacttgagcccaagagtttaaggttacagtgagccatgatcgtgccactgtgctccagtctaggtgactgagtgagaccctgtctcaaataaataagtaattttaaagagaaatgagatctaatttctggatattataccatttgctaaaccaaaattcctacattttaaaacaagtcatataccaaaaccttttaggattacactctggcctctgaatcaacaataccctaagaagaactgccaagactagaattctgtccatagtatgtggtcagctctgcagtggtctttctcattcttgaggcagtccaggttctggatgcttcgagctttgctatgaagataaacccaactctagaatgtgatggctgggccagtcccagtcaatctacatctacgtaagacacttgtttagaaagctccctttttcttaactccttgtctactatgtcaaaagccaagactcagcagaggacaagagacagttgtttatacaggtgccactttctaaagggtcctcacagaagcaaacctctccccacagagctggactcagatcacaggcctaatgacaccatggggggtgtcagtaggggtggggggatcctgcaccaaagagagaagcagggtcctgggatgagggggatgggaaccaaaacaaaattgaatgagcatagactctactttgccaggcttccacatctgggggtaggatgctatgcactaggtaacatgaaacatactaaaataaaagcatacgtggaaacgtaaagattgaacccagaattgcttatttaagtcctcaagttttttttttttttcctaaaaggaaaccacattccttcactaaccctccttcatccccacccccactgcctgaccccaagtaatagccgtttctgtccagagtttaaatgacctctgcccttccacccactttatcttctataggaatttcattcatccttttgttgcccactggaacacattgtgccctcattttccctctcacttttaatcatatgcctaaagaaagtcttgtaataggcaaaggaagcagcaatgggtaggggagaaaagatgaaaattaagtcctactgtgataaaattatacttctttttagtaggacagacacaaatgtttcttaaaaatatgagtgtatgtgtatgatataataataaataattgttttcattcctaattactaaattaagaacatataatctaaaaggcaattagtcatcttagttataccaatttcactctgtcttagtgccccaaggagaagaggagatgacacacactgagttttgaatcaggcatcaaacatctagtctgaagctgcatcaggcttggcatcaaacatctagtctgaagctgcatcaggcttgccttatctctctgcctccttcattcaggtccagctcctggaaagctacccaacattcatttcaagtcctttgtaattcaagggaaagccaagaagtaggagtgggcctacgcagaaacccctgggcatgaataaagatttgagaacttttctcaagatagttactgtgactaaaaaaataagcaagggactgaaaaaaagaaaaaaaagaaaagaaagaaaatgagacaaaagatgaaaaacacaccaaacaaaataaaaaatgaggcagtaggacagggcgtggtggctcacgcctgtaatcccagcactttgggaggctgaggaaggtgatcacttgaggtcagaagttcgagaccagcctggccaacatggtgaaaccccatctctactaaaaatacaaaaatcagccagacacggtggcacgcacctgtgatcccagctactcaggaggatgaggcaggagaatcgcttgaacccaggaggcggaggttgcagtgagctgagatcatgccactgcactccagcctgagtgacagaacaagaccctgtccgaaaaaaaaaaaaaaatgaggcagcaagttatagaaaaagagtgtcctttcagccaacttgtccttcagttctcagataaggatccacttcatccgggatgctttccctgatgccaagtcagtttaaggtatcgtcccccgggaactctcctactacattcctcatcctacagcacctatcctcgtgggctgtaattaaatagttaacagtccaccttccctactggaataacagagtgaggacagggaccatatcttgcttgtaattgcagtattttcagtatcaacattagctcatggtgagagtcagtaagcactattagaaaagtaaacaatataagttcaaaccctggtcccaccattaactcacactgtgacataaatatactcaagtttgcttatctgtaaaatgaagataagaagatagataacactgtaatgtaccggaaagtgttggtgcaattcatgccatgcaataaatgttaactgctttttcttcatgccctttcttttatttttggagacagggtctcactctgttgcccaggctggagtgcaatgacacaatcacggctcactgcagccttgacctctcaggctcaagcgatcctctctccctagtcacccaagtagctgggactacaggcacgcatcaccacacccagttaatttttgtatttgtgtttttttgtagagatggggttcgccatgttgcccaggctggtctcaaactcctgagctcaagcaatatgcctgtcttggcctcccaaaatggtggcaccacaggcatgaggcaccatgcctggactctacacgccattttattagttctcaaacctctattctgataggtcctttcctgccttcctctctcactaatgcatctcctcctcaactccatctggagtctttctgctattttacccttctctcctcttgcccttccctcctactctcctttcaatattcatttcccttacatatttgcatcatcttataatgaagaattatttgcatttgaaaactgaactttaccttctaattcacatgaagacaaaacaccttatatgactacttggctcatactccagatatgctttaacctatgattatttgtagaatgattgaaaaatctgagtaaatgctaattctataaattacagtgaaacattatgcagattttaatctatcacttccaaaagtggtgtaagcctcttttaaaattaaataaaaccctactaaaatagaattacatttatgtaaattatgtatgcaaaatattttcttttcataataacatgttaaattaagtttagcctaaagtggcctccttacatattttaggttctgcctaaaagtgtctccatgcatagtcgactgtgacctgactggatgtgtaaaaagactgtaaactacccttgtgtcaatcactgagtttcagccaattaaaggctgttccaatatcatattcaaataaggttcaaaacatcaagctataatgaagacagttgtttctgtacctcagttccattttctgtacatcactttcctctctctgtccacaaaccttcaaccatgcacagagccggagtctctctcaacctattctggctcagggacttcccgatttgcaaattgttctttacacaatttagcttgtctaaggtttcacttttaacacatgcataatttagcataattattacttaatttttgtgatgcagctttaatgctctcaaaaaacctcacttcctcaaaacatatttatttttatagaacaatgcaaataaggacaaaagacaaaacacttatatccttaaacccaaaatcccataaaatatctctactgacctttggtgagcaggatttagtattatgacccattctccaaagaagaaactagccgggcacggtgttgagcacggtggctcatgcctgtaatcccagcactttgggaggccaaggcgggcagatcatgagttcaggagatcgagaccatcctggctaacacagtgaaaccctgtctctactaaaaatataaagaattagctgggcgtggtggcagacgcctgtagccccagctacttgggaggctgaggcaggagaatggcatgaacccgggaggcggagcttgtagtgagctgagattgggccactgtactccagcctgggcaacagagcgagactccgtctcaaaaaaaaaaaaaaaaaaagaagaagaaactaaatcaaagaacgccaagctaccacctctccctggagaactgagaataagcaggttatcgcaatagcacttgtctactatgaataagggacgagtctaaactgtacttagtacaattcaaatgaaggcctgcgtgcttctagagcatttttcataattaaaaggggggaagtgttatgaacaattaaagcctagatacagatgtgtgaatgtatgtgtgtggtttatggatgaaaatattctcaagttttatttcagtatatgtcagagaatctgtcagatgccaatcaaactggcacatcacactgactccatcccaagtcaccatctggataactgcactcctgacaccatctcttggagagggggcttttcaatgtaatgaaaatatcagaaaaattgcaaaagtcactgttacatgttttttcccaaatgtaactaatcatttcacctgccattccattacttagttttttgttaataatgttggaagtaataaaggtttctataagatcttgttttctaatttttttttcttttcttttcttttttttttttttttttttttttgagacagagttttgctcttattgcccaggctggagtgcaatggcacgatatcagctcactgcaacccccgcctcccgggttcaagcgattctcctgcctcagcctcccaagtagctgggattacaagcatgtgccaccatgcccagctgattttgtatttttagtagagacagggtttctccatgttggtcaggctggtcttaatctcccgacctcaggtgatctgcctgcctcagcctcccaaaatgccaggattacaggcgtgagccaccgcgcctggactattttctaatttctaaaagattctctgaaatatttaatcaattacaaagaaaaagtaaaactttctggcttgatacaagagaatgacacaataatcccaggactttttaatatttaagcaagtatctatatgttttttcccttttcataatttccttccatttttttcccttttaaaaagactcttttacagcagttttaggttcacagcaaaactgagcaggaagtacagagagttcccatatactcctaaacacagacaagcacagcctctcctacaatcaatatccctaaccaaaggggtacatttcttacaatcagtgaacctacattgacaagcatcatcaacctaagtccacagtttatatcagggttccctcttggtgttctatgccatggttttggaaaaatgtttaatcacatgtatccaccattacagaaccatacagcataatttcagtgttcaaaaaaatcctgcgtgctcaacttactcattctccctgccccttaacttctggcaaccactgatctttttactgtctcatagttttgctttttccagaatgtaatatagttcaaaggacattttggttgcttccaagttttggcagttatgagtaaagctgttataaatatccatgtgcaggtttttgtaaagacataagttttcgactaacttaggcaaacaccaagcaatgcactagatcatatagtaagagtatgtttcgttttgtaagagactgccaaattgtcttccaaagtgactgtaccattctgcatttccacctgcaatgaatgagaattcctgttgatccacattctcaccagcatttagtgttgtcagtgttctggatttctgtcattctaataggtacctggtggtagctcactttaatctgcattccctaatgacatgtgtgtgaagcatcttttcatatgccatatgtatatctactttggtgaagtgtctgttcaggtcttttgcccatttttcaatccaatggttcattttcttactattgagttttaacagttctttgtacattgtacattttagctaacagtcttttatcagatatatctttcacaaatattttctcctagtctgtaacttgcctcatattctcttgacagtgtcttttgcagagcagagtttttaactttaatgaatttcagcttatcgaatgtttctttcatatactgtgcctttagaatgcatctaaaatgtcaccaccaaatctaagttcatccagattttctcttcttggagtttcatagttttgtgttttacatttagatctgtggtccattttgaattaatttttgtgaagagtataacgtctgtttctagattcattgtttgcatttgaatgtccagttactccagcagccatttgttgaaaacactgtcttttctccattctattatttttgctcctttgacaaaaggtcacttgactatatttatgtgagtctatttctgggctctctaatctagttcattaatctggtttgtctttctttcaccaacaccacactggcttgattgctgtagctttacagtaagtcttgaagttggatggtgtgagtcctctttgtttttctccttcaatattgtgtaggctattatggggcttttgcctcttcatataaacttcagaatcagtttgtcaatatacactgatatagtttggatgtctgtcccctccaaatctcatgttgaaatgtaatcctcaatgttggaggtggggcctcgagggaagtgtttgggtcatgggggcgcacctcttatgagtagcttggtactgtccttgcaataatgagtgagctctcacgagatctggctgtttaaaagtgtgtggcacctcctccctcactctcttgcttctgctcttgccatgtgaggtacctgctcccacttcattgtctgccatgagtaaaagctccctgaggcctcaccagaagccaggcagatgccggcaccatgcttccagtacagcctgcaggactgtgagccaattaaacctttttttctttataaattacccagcctcagatattcctttatagtgatgcaaaaatggactaaaacatccacaaaacaacttgtttggattttgattgggattgtgttgaatctatagatcaagttgggaaaaaaactgacatcttgacaatattgagccttcctatccatgaatgtggattatctctcatttgttttttatttctttcatcggatttttgtagttttccttgcacagatattgcatgttttgttagctttatagctataagtatataggtccatatatatgtgtatatatatataagtattcattcttttaggtgctaatgtaaatggcaatgtgtttttaacttctagtttcatttgttgatgccatatagaaaagtgattggcttttgtgtattaaccttgtatccttcaaccttgctaattgactaataaggactaaaaaaactttcaggagttttgttgtcaattcttttggattttctacgtatattatcatgtcctctgtaaacagacatttttatttcttccttcccaatctttataccttttcttttctttgtcttataacattagctaggacttcctgtataatgttgaaaaaaagtggtgagaggggacatccttgtcttgttccttaccttaatgagaaagcttctcttttctccattaagtatgttgttatctgtaggatttggggtaaattttttttcttatcaagttgaggtagtcccctctattgctagtttactgccagtttttatcaagaatgggtgttgaatttggtcaaattctgcatctactggtatgaccatatagtttttcttctttagtttgttgctgtgatggattacattaattgatttttcaatactgaaccagccttgcatacttaggataaattccatttggtcattgtgtataattcttttatacattgttgcatttgatttgacaatattttggtaagacttatacacctatgttcatgacagatattgcagttccttttcttgtaatgtctttatctggttttggtattaggttaatgctggcctcatacagtaagttacaaagtattccctctgcatctatcttctgaaagagactgtagagagttggtataatttcttccttcagtgtttggtagaattcatcacatctgggcctggggatttgttttggaaggctattaattactgattaaatctctttaataaatatagacctatacagattgtctcttcacttcccttagttttgtttattattgaagtttcattatatttctctcagaaacatcaaattcacagatttattatctataaatatgtgggatactaatttgttttctaatagtcaagtaatgtattttttgttttttttttcgtttgcttgtttgtaacttcctgtgtgtgtgaagcgtgaagggtctcacttcatcgcacaggctggggtgcagtggtgcaatcatggctcactgcagcctcaacctcctgagctcaaacaatcctgctgcctcaaccccccaagcggctgggaccactggcacacaccaccatgcctggttaatttttgtattttttgtagagacaaggttttgtcctgttgcccaggctggtcttgaactcctgagctcaagagatctgcccaccttggcctcccaaagtggtgggattataggcatgagccaccatgcccagcctaatagtcaggtaatgtagtatctgtgatatatgttagctatatttgtatcagtagtttaaggcaggcaaaatattactattgaatctttagaagtccatattcttagtttgttataacacatttggaaaaaaagaaataaagaaataaaaataaaagtctatattctgaaaaagcttcgaaaaaattggaaattataatgttttagaaattataattgtaaattatgaagtttaagcatttaaaaattttcattatttgtcttcatgagacctaaattaaagatattcagctatttttaatttttttctagaagattttgagatatattttctggctaaaattttccataactgttcttgctccttttattgttgttgtgaggataaataaaatctatgcatttactaccatggagcacataaatgtctgttcagaaataagaaatgctttctccgccaggaatggttgctcacctctatagtccgagaactatgggaagctgaggtggaaaaatcagttgagcccagtggtttgagaccagcctaggtgatgaagtgagacccccatctcactcaaaaatcactaattcaaaaataatttttagaaagctagttaattgtcttcagtatttttccttctatttatatttttgacaatttgatatttcatttttcaacattataacttataataaagcaaaatactatctagtacctcatgcagtacacttcccatggtcttccatttttaaaaagtgagtttgggctaggcgcagtggctcatgcctttaatcctagcactttgggaggccgaggcaggcggatcacttgagctcaggagtttgagaccagcctgagcaacatggcgaaaccccatctctacaaaaattacaaaaaaaaaaaaaaaaaccagccaggtgtggtggtacatgtctgtagtcccagctacttggggagctgaggtgagaagatcgcttgagcccaggaggttgaggcttcagtgagccaagaccatgctattgcactccagctgggtgacaaagtgagaccctgtctcaaaaaaaaaaaaaaaaaagtgagtttgaaatttaaaattttcttgctatttcttatatagtcagacaaggcttggttcaacaccctgagctgggttggcttgacaggactagcactagacctgacccagaggtaaaggcaattgtgggaagagcggacggacctgggaagaaatctagaagccaacgagcagaacaccaaagcttgtcactgggcaacagagaactggtccaacaaagctgtcaccatcagaaatgtgtgtcaccaggtcagagaaacaggaaatcaaggcaggtaacgggagacaaaatcaaggaaagtcagttggcaaaagggcccaggacacgagtctggaactcgggtaactgaaagaataggaagtactagagacagaaagaaaagcctaaacctgaaaggtgtacaagacaagttactaaaccaggggttctggacaaaggaataaggcaaaggactacaaggtcctggctagctgagcatcagatatgaggaataaaacattggcctgggagaagggaatagggagttactgtttaatggatacagagttttagctggggaagctaaaaaaactctatagatggattctggctagtgatggtcgctcaacaatgtgaatgtacttaatgccacagaaccgtatactttaaaatgttaagtcttatgcacattttaccaaaaaacaaaaaaaagtttaatgagggaaaaaatgttttccagcttcattgatctaagccactgggtctcttcaatttccctgagaacattcctatggttttccaaatcatcacaacacaaataatattcttttagattgaacttccagcaagaaattaatttaaatgtgaatgctattatccctatggggaataagcagtagccagggtttgcatcagaactgagtttgatatagtcatttttatcttaaatgtatatgtatgcaagtgtgtaatatatattattatatattgattatacatatatcaatatatgttaatgatatgtgtaatatatgtaaatataatataatatataatataatataaacatattctgtctataatatagaatatgtttatatataatatagaatataaatatataatatataatatataatataaatatagaatatagaatatagaatacagattatagaatatagaatataaatatatattatataatatatagaatatagaatatatatattatagaatatagaatatagaatataaatatatattatagaatatagaatataatacatgttatataatatatataatataaatatattatatattttatatatagtatatatatatttgcccccaaaacaaaagcaaaacactggcctggtgcaaaaactccttttaccctttccctggagccaggagagcctggggataagattcagtcactcacagggaagggcagctgcagaccagggaccaaaagtgaacaccaccatctcaatctaaaatgcagatacagccaaagactaatttaagaattagagcagcattactgcctttttatagctggtgaaagctagtgctgaaatacatatacaggtatgcaaactaggtagcatcatactcaataaatacatgaattaactgattcattaatggaaagaagcatttaagaataaaaaatgttaagtaaaagtaatccaggagtaaaattttgctttaagtaattaggagtcaatgattcattcaaggtaccttcaatatattcaataaataatttacagtatttagcagtcagacttcttaacagactttgctctctaaaatatgcaaagaatcatgattcctccctccaaatacaacttcccaaaaagttaccagactcaaactccttaataaccctttcttacataacagagaattcacagtaagcttaactatctgatttcccaactcacaaaaaaattacaatgaggagctgatagacgcaagcataagaacagtggaagaaggaacaactgacctttacagaagacagagaaaaccccagagtctgtattaagacaaggtgcaataatgagtatacatactggcaaccctaaatcatcaggagagggttaatttatgccaaatcgtttctgttcaatcaatataaggaatacttgatgtattcaagaaagtatttaataaaaattacagaaatttaaaaagggctctggtatttggcgtaacaaactccagttaggtatatattcacccatgacaacaccttacttccaataaaggagtcattactttattttcaggtttttcctcctaaaagaaactatttcaaagctatcagagattattcgcttacaaaaaaaaccaaaaacccccaaaactaatgtactctcctctgagatctctaaccaaatatttgagggatggtgtataaggagcagcttgtgtttgttcttccttgtctactgttttgtatttccttcaggcctatttgcaggcagagggccagtagacagctgctctaattactcaaagaactcaaactcaagaactgtattcatgcattcttgctgttcaaaccaggggtttataaattttgtaggtgagaatacttcttcatttttatccctctactactttctctcattaattattagaaaatcaattatttacatgtcgccctgtatgcaatcgttattcacttaaatgtcatgctttttattcctagatttttattttgtctcaaatgactaaaatgatacttggatagacagtttgttattagcaatcaacttccaggcgatcagtacaaactagcgtgtggtactctaaattacaggaaagacagaagagagaaaaaaagaaaagagaaagcagaaatgtgggttttgctgcaaagaaataccaaaattgtttccaatcagtcaaagtgaatcatctgtctaccaacatgcctcatttttcattgtctataggtaacttagaaaagagtaactaatgcaaggaatagttttgttataaaatgtgcataattttgactgctttaataatgaaatttaaattcacatgtatttccttcttttctatgaacttcttttaatcataactggaaaaaaaatgtcaagtggtgtccacagctagctgacacttcacatgaagattgaagaagaataaatttcattttaaatacatgttccttcgcaagttctgtgattaaacattcacgctagctttcctcggtcaaaaatgaaagaaccgaatgaacttctgtttgatcctctcctccacaggataaattttcctttttctagtacatttagagtgcatattttggcaagtgtggactagggagtggggaaggtgttgtgggtggggaacacttgctttcttccatgagagcaacccctgcctggccttcggagagattttagcaattcccaatcctgccccacttccagcagtctgggcacctgggcacccagctccaatgggattagctttcactgtactggattcctctgtcaaacaactgacccgcaaactctatagttaccaccatgcaacacaaagcttgaacatactaacaatctgttactattcactggtgtgtaatgtacacaggaatgtgaaattacatggaaatgcaatccggagtaaaaatctaaaaattcatacattgtattaggttagtatttataatttccaaaaacaaagtcattgaagaggtcatgatttttgttaaaattaatgagattaaagatcaggcacaggttaaatttgccttcaaggcagaagtttagcagacaaacaattctggtttagttaaaagtacatggtctttgaactctcgtgtcgaaagagttgaacacaactaaactttaatgtgaaaaggtctcaagtagttaatcagaaatgagaggcgcacatagcattttatactgttttcgatttgctgacacaacatcattctgtgctctctagtgagcaagagtaatcctcaatagcattaagacgaaaggctgaacacaaaaccgcaggcaagtcaagtagtgattttattctttttgtcatttttctttcaagtggaagatccctaacactctctgctcctgacaatgtttataaacagaactctgagaagcatctgaatgtaaaaaaaaaataggtctctccaacaaactgtgatagacgatcaaccagctgagtcctcttccagatgacatggggttggaagtacttttaagacctagtttccacaaaaataaaactcttaaaattactcaacttgctgggtctgatccctatgaaagaaaaatagtgtataacataagatataccataatcagttacaccaacaactcagttccgagaaaagtttgaaaacattaacattggaaaagaaagttcaatcaaagacatgcattaggctaaaacgttctttatgatagcacttcattttaacatataaacactatgctccttataacataccttgtaatctataaaataaaggcaacatattttatgtctgataataaaaaaaagttaactgctaaatcctagatgacaaaacacttcatcttttaccccataaaatttgccctgaattttaaaattcatcacttacgtaatatctgaattctacaactctgatagccttttattagcaggctatgtaaagatccaaaatcgttacacagtacaaacagtgaactgctaagctaaagtataacctttttgcttaactggatagactaaagtaataatagactatgtaatacaaacttctcaaagtaagtcttcgttcccctcatccatcccaaaaaaacactactaatagtttttccttgaacatctatacattatcaagtgtaggtgtctactatgtaataataatatacattcaaaccacctttttgggttttcttaaatgtaggcttatcttctgctcaaagcaaagatactgcaatagaaaatcagcaatgtgacaattataatatgctcttaaattataaatcaataggctggtcatggtggcttacgcctgtaatcctagcactttgggaggccgaggcaggtagatcacttgagatcgggagttggagatcagcctggccaacatggtgaaaccccgtctctactaaaaatacaaaaaattagccaggcatggtagcagacacctgtagtcacagctacttgggaggctgacgcaggagaactgcttgaacctgggaggtggaggttgcagtgaactgagattgcaccactacactccagcctgggtgacagagctgagactcggtctaaaaaatacatatatatgtattttatatatatatttttatacatatttatatatatatataaatcattaactgttctgtatattttgacaacttcctaagaggaatttaagataatagaatttcattccaaattaataacattgttaagataaatactgtaacaaaataataacaaagtctccttcaataaaagtggaatagtaatctgaggacaaatttcagtcagtttattgcttcccttgttaatctttcaccttctaaaatgcattttacaactaaaactgagaaagaacttatgttaacaactctctattttgtgacactttaactttaatggaacatgtttattccttcctgctcccaacgacacttccaatacatgagttcagctaagaaaactcagttctaaaatggcaagttctcagctgtctatgaagccaaatgggcggctataaatgcctgtgtggacagcacccctgtcctcgcatggatttttatgaggcaccatgtggcacccctcgtggtttgcccagctgcagctcttcacaaggcgggaaacacatgtgacattgcctccaacttcctctgccttcccaagtggcatcagtcctccaacacgcagactcactttaaggcactgaccctggaccttcctggggcctttctgccaggaagatataaaagaacatctattcattccattgacaggtaacagaccctcatcaagtgcaaggtgctgcactcaacatgtagggatagtaacatgcaatggccactaagcatggatcagaagggaagatagaaatataagccaccacacctctccacaaaatgcagcacatataataagaaatacacatcacattctatgagagttctgaggcactggcaagatcagagaaggcaatgtgaaaggggtggtggctaaaatggccctaaaaggatgggtaggaattagagatgcaaataaagtacactatggatagttaagaaaagagagggaaaccagagcatgaggcaggcagggaagagacatccgctcactcattcagacaacgaatgtttactgaacatatggtcccagatgtgggggatacaccacgacacaccatgaataagacagacagtcactgattgcttggagcttactttcttttttaaaaattatgtccttctttccatgttcaaatatctaaaggagcttactttctaatggggtgatgggcaagcatatcaacaaataattatagaagttaatttcaggttgtgataagcgcaaataaaaataaaccagggtaagagcacagtgggtggagataggtaatcaataagaatgtgatatgtgagcagagactggattcaagtgtggaagaggtgatcctaaggaagggagccaaaaaagcacaggcaaaaaccctggggcagaacagttgggcatatttaagaacagctagaaggccagtgtagctggaagaaaatacgtgaatcaaagaggtaagagatgttgctggaaagataagtacaggtaagaatgaatgtttctccttaaaggcaccattgacatttggggcagaatactgtggtcttgttgtatttagcatcatggcccttgtggcactaaatgccaacagtactgtccttgtaacaatttagaagctccactaatttctaaacactcctatgagggacaggaagcaggcagtacatcccactgagaaccactgagacagatcctgtatggccttgtggtcataaatatgattttgttctaagtgtaaggaagaagccagtagagagctataaacagaggaaatggcatattgcctatttctagaaggccatgatctaatttcctattttttttttttttgaaatggagtcttgctctgtggtccaggctggagtgcaatggtgcgatcttggctcactgcaacctccacctcctgggttcaagtgattctcctgccttagcctcccaagtagctgggattacaggctcgcgccaccatgcctggctaatttttgtatttttagtagagacggggttttgccatgttggccaggctggtctcgaactcctgacctcaggtgatctgcctgcctcggcctcccaaagtgctgggattacaggcgtgaaccaccaccaccgacctctaatttctatctttaaaaaatgtctctgtctactatatggaaaactggctccaggggataacagtagctgcaggggtaaccaggaacaagactactgcagtaatgcaggagattatgacagcttggcttgggtaggtgctcagatgtaataagatgagggagatcttgaagactgagccatcaggatttgcctaatgtggcttcacctagctagagcagagtattgaagaggggaagtcaaacatgaggctggaatggaaaattggggccagattccctgggggcctagaaagccagcctaagggacatcgagtctcattctgtaacagggtgcccaagggttttatactttaagcagagtaatccaacagcagttgggaaagaagagagactaaaaagagggagaccagctcagacagagagagaccaattaccacatgcctgggagtaaagagagcaaagctctgcattgatgaattcaaaaggtattaccaagacaaggttagtgccagttaatgaccagctgaccctgagatttaaccctgggcaacagagggatgacagggacatgaccaaagcaaagcatcatgaaaggagaagaggatttgaaaaggaaggtagtatgacctgcttcggcttcagacatattaggtttgaatgctggccaacttcacaggtaggaaaagtcagctggatttgtggaaccagagctccagcacaagtgagggctggaggcaattgtttgggagttatcagcaagatggtgacccctaaagtcacgagacggaaagaggatcaccaccagagaaaaggcagacctcacaaaacaccttagatagaacgctagggacatgaggaagggaagtcatttcaagaatcatgctgtgtgcaagagggttaaaagcacagatgtaaaggagggtaaactgggtaaaaggccaatggatttagtgactaagagagtctggagactgtcaagactgcagtttcatcaagacagaaaggtgactgcaatgttaaaggaagtgagtcagtctgaggaaatgtggatgagcctacactatttttcaaggattggttataaaaggaaagtgataaaagtgatggtagcttgaaggagtagcagagttgagggtaggttgggtgagtgtgtgtgtcttaaaagtaaaaatagttaacttgcagagcttaaagagcagaatccagtggagagattgaagttgcaggatgatatgacccaccaacgacaagaaaacagaagagatgagcagagacatgttacccttagaaagaggaagagacacctgttcctctggcagataagggaagatgatcaagcagtggctgccatgttgctgacagcccccttaaacacaacagaagagacaatgaataaagctattatatatatagcaacacacttctgataaccacttctaggagaaacaatattctgactaatgccattattctacttaatgtcgtgacatcagaacaaccaaatgttgtgactcatagtttgtctcttttgtttagtgcacttaatatgaatgaaagaggtaggtggataagtacctttggtaagtgaatgaagaaccccccagacaatgcaaatcacgctatagataaaagagtatattttgtttctgaaattaatttaaactcccacttggtttgtctttcacagtcacttgacatttataattcagttgcaaattcataaatcaaaagcattctgcttttcatcacagttgtcgtgtctacatatcaaggttttcctggtcaccataacactaccattccacagcagtgaaaagcaaaatacatggaatgttataatgaagaaaaatttgagggagcctgatttaaagaaaaaaaaaaaagagcaagaaagatcagaatacataaactaagtaattaatgagatcatcaaagcccatgctaatctcatttaaccattccttacccccctagaaagggagatacagaaaggcacacaacagcagcaaatgactttaggtcagtagcttttttaaaaattggccacagtgcaccatcaattttataggaaactattgtagataataaaacctatctttgtaaatctattttacacagtatgccaaaactgtcagtgaagctaaagtcttataataactgtgattgggatgatgaattgaatgtgttagcctagcattagtcacctaattctaaatctaaattgtactacctcagtcacctaactgcttttaaaaatacataagaggccaggcatagtggcttatgcctgtaatcccagcactttggtaggctgaggtgggaggatcacttggggccaagagtttgagaccaccctggtcaacataacaagaccccatctctataaaaagtgaaaaactagccaggcgtcggggcacaaatctctagtcctaaatactcgggaggctgaggcaggaggattgcttgagcccaggaggttgaggcttcagtaagctgtgatcatgccactgtactccagcccgggtgacagagcaacaccctgccttgaaaaaaaaacacataagaaagaaccaagagtttaattaattccaattagaaaatgataagaatgggaaataacaaaaatcattagactataacatcaatcaataacctatttccaaaaaactctgaattaaacactaaaaattttgaaatggcaaatgaaaaacaactattctctcttatgtgcatttgaaaaatgttcctcttgaataagctgtatttatcaccaaatatttcatctttcactgataggtacatgacaaagtgattcatgtactatccatggactacaaaaatatgtagttgtcttaacaggtatcaggcatagagttggaatttatgctttagaacttgtaatggagcccacagcaatagaatgtttaaaatctgaattagcatttgatattctgaaacaacatttggcaggggtagctgggatccctggggtgttccataacatctatgcattatttattttactatactaccatactgatctacaattactctctctgtgtgcctttctctaccagtggcctggaaacaacttacaggtagaaagaccacattatctacaaccatagaacagtgcccatcgaagccagacccagttacttttaagaggaatgtcaaagggctacgggatagacagtggaatttcccacaggaagatgtaccatccctggacacgagaacagagtttattgcatttttcaattcaggaagagaaatttttcaaaataatgtcacaagagcgaatgaagggaactctacaaatcacagtcatgaagtgattcagaatcccaaatgcctgaactgaattttattaaggatttcatttcctataaaagcaacataacgcatttttaactactatttttgttcacgtagttacctccctattctactttttcagctgtttccaggaacagtgagcagaccatcattgaatagaatatatattaagtacatattctaaatgtataccttctgcaagaattaaaaatctgcactagaaaatattgcctacacaggcagatagtcttcaaacacaagtagaccatctaaacacatttcagtagacatgtgtttcccacagctgctgtaacaaattagcacaaacttcatggcttaagataacacaaatttgttatcttgcagttctggaggtcagagtacaaaatgggtctctctgagctaaaatcaaggtgttggcagcgctgtgttttttttctggaggttctaggggaaaaatctgttttcttgccttttccagcttccagaggctgcctgcatcacttgccttggggccccttcctccatcttcaacaggaggttgagttcctcatcacataacatcactcggaccttgtcttctgcctcgctattccacttctaaaagccccagtgattacactggactcatccaaataacccaggatcatcatctcctctccaggtcagctgattagcaaccttaactctttgccatgtaataacacacggctctggggattaggatgtaaacatcttgaggggagggaaagggaatgacacattagtctgcctactgcagcatggaatcatccatcagtacactttctattttatttttcatacagactcacagacatataccacacccatacccaaaagttttttagatttccctgccctaatttgataattctagactaattctaatgaatacttccacaagtgtctcctataattttgtaatgttagaattttactttaaaaaaacaaaaaaaattctgttcttcgaaaaacaaacaaacaaacaaacaaattccagatggttccaagagtgcaaacctgaaaacagcttaacctgatttatttttttaaaaaaaggcatgacagtctcaccaggaaagagctcttttagtttacagggtttgatacgtaatataatcatacttaagagttttgttttgctttttgttttctgttttgagacaggatcttgttctgcggcccaggctggagtgcagtggcttgtggaaaactgaactcatctttataattccttttttattgagacttacctagaataattaacatttgaatttaattaaaaacagttcttttgtcaaacttaacccaattctccaatacttttgtaggtcaccttctttaataacaatcagaggaagaattttctgactcttcaaaacagcaatctaaatataatactttattgtacaacacatgatgtctttttttttgtgtcccaaattgtgttccttagaacacctggaaacataaattggtataccacccccccacccaaaaaaaaaacctattcggtggccacatacatttggaaaaggacgtataccatgcctctcttttagagggtcacaatgcatactaagtgttaaaagtcctctaactttgtttaacatcactgttttcagaacgttttcctaacatccctataaataacctgggctgaggcaagaaagtgagaagtgaatactaatgtagagcatatctccacagagtattactcatgagtaagccccacagcttactcatcacaactgggaacaaaaccagccccactttatgctcctgagagtatacgacggatgaaaggcatttcaaatatcaaatgtcaaatcaatgccaaattgcaactacaattaaaatctacttgaaacaacacaaatatgaaaaggctcctgctgtctctaattgtatttacatgagtgggtcctttaaaaaacaatgcttggccaggcgaggtggctcatgcctgtaatcccaacactttaggaggtggagacgggtggatcacttgaggtcaggagttcgagactagcctggtcaacatggtgaaacccagtctctactataaatacaaaaattagccaggcgtggtggtgcatgcctgtaatcccagctactcgggaggccgaggcaggagactgcttgaacccaggggcggaggctgcagtgagccaagatcacgctgctccagcctgggccactaaatgagactctgtctcaaaaataaaaataaaataaaaaacaatgtttaattcaatatgactttaaatggtgcacagctaaatgaacctacccatgtttataaagaatccaaatgtatctgattcaaaatactgaccctcaaatagagccgtggatgccccatccactacacataagcaagagacagatttatgaaaagcatttcaaaatgttttttccttcatacagagtaataaatactcaattaaaaggaattaaggttaattctaaagagatgggaaatttcctttagttttcatttgtttttctataaaaaatagaaatatttcaatctaaaataaaaaatctcaaagctaaaaatattaagtatcaattattcaaatatcactgattccacgtgggcgcagtgactcacacctgtattcccatcactttgggaggccaagatgggcagatcacctgaggtcaggagttcaagaccagcctggccaacatggtgaaactccatctctactaaaaatacacaaattagctgggcgtggtggcacacacctgtagtcccagctactcaggaagctgaaggagaatcatttgaacccaggaggcagaggttgcagtgagctgagatcgtgccattgcactccagcgtagatgacagagtgagaaaccacctcaaaaaaaaaaaaaaaaaaaaattactgagtccccctctaaaaaattctattaaaatgacaattattttttaagtttatagccctcaagtataaacaataggctcaaaaggttgaaaaacagtgtcttggtccactcctgtgaggtgctaaaatgtaacgaaaaggccaccggtgctagggcataggaaggctacttaccttcccagagcccaagtttcttcatctgtaaatagaaggtggtcgtaatacttacctcatggggttgttgtgagaattaactgggttaaagtatacaaggcacttagaatagtactggtacataagcattccacaaatgtggcccattattacattattgttgttcttactatactttttctggtcatgtttgttatcccaaatttgttactcataaataaaaaggaaaataagttgggtgtggtggctcatgcctgtaatcccagcactttggggggccaaggcaggcagatcacgaggtcaggagttcgagaccagcctgaccaatatggtgaaacccagtctctactaaaaatacaaaaattagccagacgtcatggcgcatggctgtaatcccagctactcaggaggctgaggctggagaatcgcttgaatccaggaggcagaggttgcagtgagccgagattgcaccactgctctcctgtctgggtgacacagcgagactccgtctcaaaaaaaaaatttttttttttaataaataaataaaaaggaaaataaatttctcctacactcaagattctaaataactaagattagtttttgctcaaagctgctatagaatactcactcctccatccaacataaccacccactatgcattactgctcccttccaaatcacctggacaactaacgcctctttctacttctgtgtgaaccatctgttttcaattactgactcattcacttaatagtcatcaaatacctactacatgtcaggtactgtttgacattagacattcaaggatatataagtatcaggtcctgtctttaaaaacctgttattctagaaggagaagaaggggaaaagtatttcaacagtttaaaattttttcctctaatggagacatattccagacatagtattagcaaaaaggaagaccttacggcctccactgaagggagagagcaccaggccaggtttctggttaggtagacaggtactgcaggacaggagagtttgcaaagccaggcatacaggaactggcttagagcattttaaacactggatggccagtgtggccagtacgagcgctagtaagcacctgtgaggcaagaaaggatatcagacccaacaggctcttggagacagtgccaaaatttttggactattgttaaggaattttaaaagggaatgatgttcaaatccacatttgggaaagaccgccatagcaatgtgaagaatgaaatggaggaagcagaaactagaaacaggtagaccaagtcagtgagctttgtgtttttcacagtgtcttcgaaattagttcactgttaccataactctgtgtggcgtgacaactgttattcatttgtaatggatatgaaacggaacttcaaaaagatcacaagacttgcccaaagtcacataataatgaataaatggctaaaatggcctccagaatccaagacttctcatcatcccactggtcctttctctccaatccctagaggttaaaataaagtacaaactttggtcacatcctatcccagagcagcagtttggctgcagcaaatgaattcaagtttacttgagttaataatcagatactttctggctgtaagagcatggaacatttatcatagctaaataaaatgggagttgattgggtaaattttgataaactgtactttaatcctgaaaaatggctgctactagatatgtttttacccctcttcagtgatacacttcaaagccagaaataaggttcatgcccatcaaataaataagcaagacttcagtttaaaccctaaactctgaacatataatctactagtctactgatcggtagtgtgaactgcctggttgtaaatatcaagccttcgtatgcagcagattatattaatggtaaactgggccaagcgcagtggctcacacctgtaatcccagaactttgggaggccgaggcaggcagatcacctaaggttaggagttcaagaccagcctggccaacgtggcaaaaccccatctctactaaaaatacaaaaatcagccaggcgtggtggcaggcacctctaattccagctactcagggggctgagggaggggaatcacttgaacccaggaggcagaggttgcagtgagccaaggtcatgccactgcactccagcctgggcaacagagcaagactccatctcaaaaaaaaaaaaaaaaaaaaaaaaaccgtggtttactcagaacagttggtaaatgggatattctgcttaatttaacattccggttatctggaagtcaacatgtacagtagcatatatatcataaaataattaccaaatttcaaagaattagaataaaataatttaaaactaaaactatattgagtatgattattcatagtcatcatttcaacagctattgataactaatgtttattgaaggcttatcacaggacaggtacttttcaaagtgttttatatctattaactcattgcattacactttacttcatttaactcattgataaacacgaattgtcattgtaagtcataaaaaacaaatgtggttgtcttagatggctttggttgtttggcttctgaaaaaatggaagttatatttgactgcaataattcattgactgattttcttcattgcctccaggtaatgagcaacttaatcagcaaaccacctccctctaccctattatttcacagaaccattactctttcatacttgtcagctctgcccttacaagctgacatttcattaagagacgtaattgaaaatctagctttcaggtaagtctgagggtcttccttcccccacgatttctctatttccgcccctgcctcagagcagctataaaccattttctgtccctgttagttaccatctgcttccccatcctgtattctgagataccctccaactgccattctgattcacagctgaaaagcactcctgattttttgttgttgtttttcctttctgatgtcactctgttaactctcagtctctgtttagaccaccggaacacccctgagaaagcagtgtcctcatacaaattattctagaacagtggatctccactgggggcaattttgctcatccccacctgccaggaacgtgtgacaatgtcaatttttttttaaattgtcccacttgggataattaatcgggagtccagaaggaatgtaccactggcatctagtgggtagataccaggtatgctgttaagtatcctagaatgcacaaaagaaacaccctccccaccccccaaaaagaattattcagtctaaaatgtcaagagtgtgaggttgggaaaccctgatttagaatatgatctcagacgaaataccatggtcttccagttctcccctgaagcaaattaaaacataactcctcaaatatactgccatagcaacttaagaacattttggtgaagttcgtttgggtgaagaacatttacatctaaacaatgatatcctaatagctgctttcatgggtgagaattaattaacaaacttctaacactggacttgccatttaatagactttgctatacctcacagcacagctttggtagaaagtactgcctggcattgtttggaaacaccctcataccatttccaatagatcactacaatgatatttactgcaagcatcaacctgtatttttttgtactctaagggatcttttctactaaaaacaattcacggtaaattgatttctatttctaagtcggggtttctcagtcttggcactactgacatttgggcctgatagttgtttgttggggagcgtggctgtcctgtgcatggtaggacgcacagcatttctggcttctacccacgagatgccagtagcaaccccctcccctgcaccccatgacaaaatgtcaccagacattaccaaatgtcccttaagaggcaagatcactctcatacccccattgagaatcactgttttagagggtttttttaaaatcaacttctaatttaagtttcccacatctagattttgatatattgggtttgctaggtacaaatatattgaataactaaaccaacaaattcctgtatgttgatattcttaaaatagaattcctataatcctactgtgcaaaacaagaatgaatacaaatggaaattttaaacactaaacagtacccaagtatcatctagcttacataacaacacagtgatatccttacagactaaactcgtcatcaaagtattttgtttatggttaagtttttagcaatgtcatttactctctggcatgacaaaattcataataaaaaatagctaatactcattcaacatttactatattagtgttttatagtgacatgcacacaatttttaagtcccttccatgatatgataactctgtaagataggtactattattatttccatttaaatatgagccaactgaagcacagaacggttaagtaacttgcccagggtcacacaggcaatctgtgacagagctggcatttcagcccaagcagcctaactcaataactcaatccacattcttccgtgttatgctacattgcttctcatataataatatgccatattaatcattacatcagcaatgagcatatattataaagggattttacttaatttccttcttttcttttttttttgagacatagttttgctcttgttgcccaagctggagtgcaacggtgcaatcttggctcactgcaacctccgcctccccagttcaagcctcagcctcctgagtagctgggattacaggtgtgcaccaccaggactggctactttttgtgtttttagaagagacagggtttcaccatgttggccaggctgctgtcaaactcctgacctcaggtgatccacccacctcagcctcccaaagtgctgggattataggcgtgagccaccgtgcctggcctacttaatttctttcagtgacatttcctctgcaacctaagtgacaaaactgttctggacaacatttgcctcaggatccttgccatgtgttttctgacagttctagccactggcacagcatctgtagcccaactgcccagatcccagtcctggctctaccataaacattacgattcttctctccctctagacacatggcaggactgccctttccgacctccttgaaatggaatcatggcctagtaactcactttggacaatgaaatgtgggaagtaaaacatgtcacttccagatggaagctttaagccagaactcgacttgccaattcccttcctggaagcatgtgctgagatggagcctttgtcggctgggtctctgagtgactctaatgactataatgagcggtgtccctctgccaatccacacaacgtataccttgagtgagaaataagcctttgctgtattaagcatctcaaatttcagggttgtttcttactattccataatttagactaagtaatatcgttacttattagttggtgtgaccttaaacaagttatgtaacctctctatgtctgcttcctcacctggaaaatggagataatagtagcaactacttcgtagtgttgctatgagaattaaataagttaatatacataaagtacctaaaacattgcctggcacacagtaagaacccactactgtccccagaaattctcatgtaagctaactcatggatatcattactctggtcaccagtctctaacaatctgagacatggatatgtaaatacatacattgcttctatattattattcccataataaaatgctacatatgtaggctcaaaggctaacaaataattcactgacagacacaaaagactgaataataaaacccaggatatcatctgttacaaaatggcatggaaaaatatctccaaaaactacaaagtagaagagagacgattgtatttaactgacccaacttttgcttctgtctcatcccctgccagtaatacatacataaacaagcacaaatatgcacacgctcccttctcaatgaacagatttaacttgccagccaactagaaagagattcaacagaaggagccaaaaatgtggtgccaactggctgtgtgacatgcacagcaatgtctcctaataaaccaacacctgacgtctagtaagtgggaatacaataagcagaagaggagtgatgtgatgtaggaaatcaacctgaaatgttcccagacacacggtgaaggtgatttgaaagtcatacttagactcatggattattttcaaaagcattaattttccaaaggtgactttcaccaggtgtttatttacctgggggacaattaaagctgatttcaggctggacacgatggctcatgcctgtaatcacaacacttcgggaggtggaagtgggaggatggcttgaggccaggagttcaagaccagcttgggcaatacagcccaaccccatctctatttttaattttttaaaaaagagaggctgatttcaagaggggaaatggttatacatacccataaggtagctgcctacattgaccaccagcatgctaaaaatatgaatttgggaattatatctccagctgaatcacaggtacagtaaacaaatccaggaaatttggctgcagtgagttctggacagatttcaaaacttattaaggagagtgccttaagaccagaagaatcagcaaaaagacacaagacagtaaagatgaatacatattactgataaagaattagtaataagactgaaaagagtataccctacagtcttataagaaataagaaataagcttattcaagacctgtaggaccaattttagcaagaatcctgctaaatcaatttatgatttcccccccgctccacacccttgaaatctgatcacccttgatatatagctcctcatctcccacctttgatctgtaagtccttggcctgcctttagcaagagtcctattaggtcgggttagcaagaatccccctacacttgatgtctcctcttaataattttcccctcttagtgaattttcctctcccctcacactctgcccattggctataaatttccagctgtctttgctgtattcagaatagagccctatctctgcctcctactgtaatactctaatgcaatatagtcttcaataaagctttacttaccatctcaaccagcatcagaataatttttcctttaacatatccaagcttggtcagaattagggtgtacctacacctacctgcactattaatactccgcacagcagggagaaaggaactacctaccaggtgtcatgggcatggaaggatgtgaggaacgctagcactggccaaatacagtggcctcacaagccatcttcaccttcaggaaaatgaatattgagctgccacagacactctgctgccctcttaatttaccattaccatgaatctacaggatgctctgttccaaacacccagtacattcttatacatcttgtcctgatagatgcctgtgaggtaggcagggctgagaattatgaattgttgtctatcaggctgaagtgactttccaaaaattgaagttgacagcaataaggtcaagaatcagctctgtgctgttttgacggagtgagtcattgcctccttgaatctggcacataccagccaactgtcaaggtttgttcttccacatggtctaactgctaaatacaaagtatactaggtttgtcagcttagggcatgtttgcttccactctgaaaacatttcagctgccctaatatattgctataaagaattctcttattattactgtcttcctcctcatatttagctctgtcttccatcacttcaaaagaagcatttgtagcttccccatcctctttctttctagttgactttgaagactatctatataagtatttctggcataaaactgacaggtaaatgacttcaaagctaatttccgcccccccccaccccttgccctttttcagtctcaagataccatgtcagtcctctattcactctcaaaaatgatggcttaactgcacagtgccgttctgggtcaattcttaaatatactagaatatactagacatatctggctcatttaagtcattcttcaccaatctttcttcttatttacctccttcctcaacttggaaattttgccttttcacaatatgtggatagccatttctgccaagattgtgccgacaagactggttataaatctacctactttgtaaaaggggaatatttttgtaaccattgcatatctctattaaaacatgaaagaaacactgaaggccaagtgttcaagtgacacgcaggaaaaaaaaaagctgatattcagaaagccaagcatacagagaaataatgagaggttaatgaagtgagttctgaatcacaagtgctgttcagaaaacaaaaaaagacatctgtgaaggctgaccttggaactagtcactgttattcagtccatatgtatgtatgtttttattaaaataactgttcaaagttaactttcatccaagttaacttctgaagaaataaaaaggcatcacgttaaggtttcaaaaatttaaccattctacctttagcaatggttagtccaccttattttcacacatttccatcttaatgaaagcaagtacattaaaggatactcagaatagctgcaaggcataccacaagatgtaccacaagattagaaatttctttaaaagtaattaagatcggccgagtgcagtggctgactccagcaatcccagcattttgggaggctgaggctggtggatcacctgaggtcaggagttcaagaccagcttggacaacatggtgaaaccccgtctctaatgaaaaaaatacaaaaataagccgggcgtggtggtgtgcacttatactcccagctacttgggaggctgaggcaggagaatctcttgaactcagaagtcagaggctgcagtgagccaagatcacgccactttactccagcctgggcaacagagtgagactgcctcaaaaaaaacaaaagtaattcacatctacagtgagaattacaaagcacaaacactccaactgcacactggaacatctaagagtaaagtcaccaaggtatttcttaaaataatcaacttttcaaaagtcaattaaaacttctcaaggggtattataataaattcagttttacttaatttttttttctttttttttgagacagggtctcactctggcacgcaggctggagtgcagtggtgcaatctcagctcactgagcctcaacctcctgggctcaaacagttctcccacctcagcctcctgaggtagctgggaccacaggcacaaaccaccatgcccgcctgatttttttaattttttgcagagatgggatttcaccacattgcccaggctggtctcaaactcctgggctcaagcaatcgacctacctcagcctcccaaagctctgggattacagagcgtgagcccttgcatctggcccccttcacttaattatttaagaaagcagtttgagaaactgttcaatttaaagataccaacgtgtattaaggagtttttgagttttcttctttaacaaataaataaattgtatctatttgcagtgtacagcatttttaatatgtatacattgtgaaattatatcaagttcattaacatattcatcacctcacacacctgtcatttcttgtgagaatatttgaaatctactggcctagcagttttcaagtccataacacattattactaaccacagtcaccatgctgcacttgcctgttttattcattaccatacttataccgcttgtacataagcccctcagtaagatgatccatgtattcaccagaccaaactaattatcacccaagcatccccctcattgcaaggaagccttttaagtgaagtgaagctttcctttttaaaactgcccaggccgggcgtggtggctcacgtctgtaatcccagcactttgggaggctgaggtgggcggatcacgaggtcaggagatcaagaccatcgtggctaacacagtgaaaccccttctctactaaaaatacaaaaaattagccaagcgtggtggcgggcgcctgtagtcccagctactcaggaggctgagacaggagaatggcgtgaacccaggaggcggagattgcagtgagccgagatcgcgccactgcactccagcctgggcgacagagcgagactccgtctcaaaataaataaataaataaacaaacaaataaaataaaactgcccaagtccatgtgaaaagtatccaagtttacacattgaaatcaatactggaaatacatgctaaatactattcagaagcgacttgaatagattttcttcagcaaactcacccttcagccgaaaggcagtgaacttcacccccaattctgcataggattacctggtctaattttgtaggagctctgtttgcattttaatccatcatccatggaagtaaaggccttaggaagtaaaggccttaggggttgagagcatctggatgtgctttggcgcagtccatagctaacatcagcactcctgaactccaccagaggagacagtgagaaagccagtgtgccctggagtagggcccaagttcagctgctccagaaatgcctctacaccaaaaggacaatgtagctatctttctaaaatgaaaaataaaaaacacaggctgaaacaaaatcctgctgaaacactgtgtgggcagaacttgaccttgcagcatggttactgagatactgcacttcttgggaaatggggactggtttcctcctgtgaggccctcagatgctcggtaaagtcaaccttgagatttccctcttctctggcccttatggctggaggccctaagtctgttaccagacttgctcgtagttaaacagcagaaagcacagcattaaacactagatttaaaatgtgaaataaaatttcaagtcacttgagagttttattcagattttaaacaaaatctgaaaagattatatatatgaacaatgaagattatatgtcaaagaatactataaataggatcctttggtgggaaaggagggatctataaattcttaatcaaatatttttctatttcaatttaaatttttttttttgtagaggagtgaaaattataatgctaaatgattctttcattcttccccaaaggagaaatactctgcctaaacccattccaatcattgatctgatgtataatttaatcacaaatataaaactgctttcacttgaaaacttttctccccacaaaaataccacttatgcagcgacccatgttctaacatctttgtaatttttcctatcaagcaatgtttttaaaatgaaatatcgcttctaaaattatccccagtggaaaaagagatttgaaatattaaattcatatgtcctaatagctaagatttgcacttacattttggatgtatttttcttcaaacattagtgtgcataaaaatctcctgggaaacttgtttgaaatgaaaatttctgggtcccagctccaggaaatcaaattctgtggatctgaggtggggcccagatactatcatttgaatgtgtcacccaaaattcatgtattggaaacttaatctccaatgcaacagtgatgggagatgggcccaatgggagatgtttaggtcatgggggctctgccctcataaatggactgtcctttatgaagggagtgggtttgttataaaagcgcgtttggcccccattgccatccatctcctgcctgctctcttgctatatgatgccttctgccatgtgatgatgcagcaaggaagcccttgccagatctggcccctcaatcttggacttcccagcctccagaaccatgagccaaatacatttctatcattataaatcacccagcctgttatagcagcacaaatggaccaagacaccaggtatgtgcatttttaacaggcatctaggtgtttctaatgcaggtggtccttggaccagactttgagaaacagcattgcatgaaaaagaactcatttccaagacagctgtccagtcttcaaaccccttctcccaaatccatactacttttatttcattagacagtttttaaacaatctctcattagcctagaataaagaaaacctttgaaatgttattctcattacaactacacaataaaaataccaaaaggcaaggcatataagaataagggaaaactgaaaagctcacttgctctaaggtataatttaaaattagaactgaactttgggaggtcgaagcaggcggaccacctgaggtcaggagttcgagaccagcctggccaacatggagaaacctcgtctctactaaaaatacaaaaattagctaggcattacagcgcatgcctgtaatcccagctactcaggatgctgaggcagaagaattgcttgaacccagcaggcagaggttgcagtgagccaagatcgtgccactgcactccagcctaggcgacagaacaagattccttctcaataaataaatagataaataaataataaataataaaattagaactggatagaatcttgattatgctaggctaattccctcagtttaatcttcaaacagtattttaagcactcccctattagttttgttatctatattctccagttatttcattcatgccacaaggtgaggtaatgcctgaaatttaaatctgtcctcaacagattcttgcactggatattcaagaagtcttgctttcatttactgtttccctatttgaactttttagaatcagaattatttatttcttctatttcatgattttccaaaagatgacttagaatgtctagaaattccctcctgactacaaatgtaatttgttgcactgactacagtaaacttgtatttttaagttacaaattcagatacttttacttaaataactgcaaacatggcaagctaccctggagttgccaaagtcaatatgtgaagtctgtctctagggcaacagactaaagagtagtaaatgaggttttgaactgcattcctgttcatttctgatttagcaacaggcttctacatgctcctattatgctctggccatccctttgtctgatctcaaaattacatggagtgagttttgggttgctgttctaatatgttttaagacatttatttcaatctgtcttgctgttctcatacatgttatttctaattttcactacccagcaaatcatatttggctgccctgcacaaacacacaaatgtgcatgcacccaccaccatttttaaatttttccatgtgaattgaggactgtaagtattcagcagcttaattaaaaatctgcaaacccctccacacaatggaccagtgctgattcagtaagtacttcctgctgcttttgtaaaagctcttcccagtattttttttttaagccactgcacagatgatctctttctacccaattctagagtttcacaatacttcttttttgtggactcaagaacacactacaccgtcaatggcagaatgtcaatcaatctaaattctcctacaacgtaagttaataatttaaattcatctaactataaccagcactgcttggcagagaaagacacacaagatccaacatcctgactaaccaaaatgtaggtagaaagagttaacctaaactgatatgtaaaggacattttacaaagtaacacatgacagaatttttttaaattgcgcatgtgttaccaaaacacaatgacaacgccacagtgctgcacttttctaaactttattagtgttttttgccgttgttataacctgttgattaatctttagattgtactattatttaacattgtattaatttaaaagtggtatataagactgtgtgaaaaaaggtaaaagttaacaaaccaaaaatacaagtccagtttttagaaaaggttttgcaaaataaaagttgcttatttatacagatcacctgacatacagaagtaaatatactacagtacatatactcgtattctgtaagcggatattccatcttaatgatagtaggactggcatcaaacatctgctaaaataatatatctatcatgctacattataaaccaaaatcctaaattggtctagattttgaaagaagttgtttatatttaccacaataagaagagtaacttgtttcaaagaacaaagtaacaatcaacttattaaatacaactttaacgctaccaactactaactgtgaagtcagaactggatggatgttgagtaacctcaaagaagaaaataaaatggaacttcctcttctgagcaaacctacttagatttaagcctatatctatggagaaaacgtgaaattttgagtaatgattgtgtatactcaagtcacaacaaaagccatgttgaccaatagtctacatatttaaatgtccatgtttcaattatccatctaaatttatctatatagtccactaaaatctactatattttgatagcacacagatgacataagcttatgtccttataccaggggtagcaaaaacagtccagaaaacaaagctccaattggtctaacatcatcaactaactgtcctcaagatcccattcttgcctacttggagaaaaccggataatccacctataaatatagcaatgatagtaaacctcagtttctgctacaaataatatggccagaaatacagcaagttcagctgatagaaaaatccgtatggcggtggtaggtcagtaataaagactgtaaccttgtaactgcaggatattctataaagtgaaatgtaatttgtaagtaatttttaatgttaccagaaaccaaaggaagggcaacaggggagtatccgtacaagaccaccttcaatagattcttccaataaaaccaaatgtactgaaaagtggtcacattagtttttaatcaaaggcaggcaagacaatcataaacatctatgctcattcacctgttcaaatatcaattgcttaagtcaaacaggaaaacacagtctgccaggggtgtcatatccactttaagtcagagcaattgaagatgtgatgggtataaaactactacagaagcccagatgatactttcactggcccctctgaaccatgtgtctgaagttggcaaagtcattcatgcaaattgtatattactatgcaaggtgttacttcgtcaagttttactttgaaatcaaattatttcagaatatttgaaataagactcagctacagtttattccaaattgaagcatgagacacgtatttcataaagagagctcagatttccaaaaataagattacccaaaaaagggggagttaactagagaacacaaattttccccagcatattttaatatttccacctcggtgtgctatatagatattatcactgaagtatcaaactgagctaggagtatgtgcaaccccgctcatctgtattctgtcactttgttctgctccacagacactgaagaggtcatgcttaatggccaaaaaattcactacgtgcctaaaggagaaagtagaaaaagataggcaggcctgagggtgtgactgtctatttaagcatgcaactgtattttaaacataattagactaattgcctcccaatcttagctgatgcatctgcacatgcaattaattagaactgattttaaaagacctgtttggaatcctttgttccccacttcctacaaatcaaattaccaaggagcaaatttaatttttcaacttttattttaagaaagacacaaacttacattaactgggtctgatccactaatgtaagtcatttaactagcaattatttcattctgaaactaaaatcccattcaaattttttcatctataaaataattccctggtaaatatgacaatcttgcaagactgctgtagaaagaaaaacttgaataatctcatagctcttcatctaaaagaggaagggggaagcaataaagttccattctgcaggaaaattagaaatgtacactattaaagctaccttttaccatgtgctttactctccactgattgttctaccataaatcaaaagcagttaaggcattaaaagaggacttcaaggggctatttagcagagtaagacatgatgtgctcactgggaaaagcataatgactgaggacaaaggttcagacactgaaactggagatggggccagaagaggacagtggagagggtcaagaagaggcaaaccaaaagggaagaggtggggaaaagagcaaaagtgagcttgataggtttagacagagattgcagtggtaaacaggagaggcagacacactcgctgagggatcttcccccaaataaatatttactgagagagtgaatggtggacggcatccacagcaacattagagctatgaacctggtccaggggagagtgatgaacatgtgataagtgaaggaagccacagagctgcaggcaggcctggtaacacgaggcacgtatgaaggtgtgagctagagcctggagaagatgcagactccagactaccatgatctgtgtctgagagtctggaatctagataggtgaacaaagtagcatcgcttgataaatggtaataacacatatagggtgggggataggagtacaactatatgggccagagagaataggattactgttctgaagacaataaaggggttgtggatcttgcgatctgagtctgaggaggcatcatgacattcctgcacacgacagaaactgtggagctaacaatgggaatagaaataggaaaagggctaatatccagaatctacaaggaacttaaacaaatttacaagaaaaaaacgaccccatcaaaaagtggatgaaggacatgaacagacactgctcaaaagaagacatttatgcagccaacaaacatgaaaaaaagcacatcatcactgatcattagagaaatgcaaatcaaagccacaatgagatacgccactccagttagaatggcgatcattaaaaagtctggaaaccacagatgctggcgaggatgtggagaaacagaaatgcttttacactgttggtgggactgtaaattagttccaccattgtggaaaacagtgtggcacttcctcaaggatctagagccagaaatactatttgatccagcaatcccattggtggatatatacccaaaggattataaatcattctactataaagacacatgcacacgtatgtttactgcagcactatctacaatagcaaagacttggaaccaacccaaatgcccattaatgatagaccgcataaagaaaatgtggcacatatgcatcatggaataccatgcagccataaaaaagaatgagttcatgtcctttgcagggacatggatgaagctgaaaccatcattctcagcaaactaacacaggaacagaaaaccaaacactgcatgttctcactcataagtgggagtcgaataatgaaaacacatggatacagggaggggaacatcacacaccagggcctgttgtggggtgggaggcaaggaaagggagaacattaggacaaatacctaatgcacgccaggcttaaaatctagatgatgggttgatgggtgtagcaaaccaccatggcacatgtatatctatgtaacaaacctgcacattctgtacatgtatcccagaacttcaagtaaaattttaaaaaattcaaaaaaagtaataggaaaaggggaaacatccacgtgagcagtccagtttcccaatctggaacttggagctgttcacctggtgggtgtttgtgactattcagacacagacaacaaaggctactccagattgaagtgcactgcttactttcagtgacctcatagaactactcaacattgtttttggtgattcctgtgctatggtttgaatggctccgctccaaaactcaggtgttgccaatgtgatggtattaagaagtagggcctttaagaggcaattagggacgggcccagtggctcacgcctataatcccagcactttgggaggccgaggtgggcagatcacgaggtcaggagatcgagaccattctggctaactcggtgaaaccccatctctactaaaaatacaaaaaaattagccaggcatggtggtgggcgcctgtagtcccagctactcaggaggctcaggcaggagaatggcgtgaacccgggaggcggagcttgcagtgagccgagatcgtcccactgcactccagcctgggcaacagagcgagactccgtctcaaaaaaagaaaaaagaaaaaaaaagaggcaattaggccatgagggctcctcccatgtgaatgtgataaagccccttataaaagaggcttcacccaccattaggctagcttgcccatagagggccatgtgaggacacagtgttcctcccctccagaggaaccatcttggaggcagagagttgccctcaccagataactgaacctaccagcaccttgatcttggacttcccagtctctagaactgtgagaaataaatttggggtatatttgtttttacaaatttcccagtctctagttacagcagcagaaatggactaagacactccactggagatataagggtattctctaattctatgtggaaagcagattatgtaccaatgcatgttaaagcacacaattatctgctggttaaaaaaacatacaaggatccaatccccccgttggagacacacagagcaacagtaggaaggatacatttccagcaagctgtgactctttaagtaaatacgtaggaggaagcaagtgcagattaaagtacagtaactgtgaggcatatgactgcagtcatgtttatgagtgacttataaagagagatttcaatgagttgtacatataacccatacagcaatgattatattagaaaaaggaaattcatctctgacattaatcatcaggctccagacactcaacagaatcggcccacaatatggttgtattattttgcaaaggaaaaaaaaacgattatctgaagtctgatttgaatccacactatatcaaatgaggaaatatgctcaagtcacgacacagccaagattaataggtgtttccacccactccttaaacagttttaggtacaaaaaacaatgtcacttctcttcctaagaatatgttaagcatagaaatttgcagaaatgcataaaaaagcattcctttccatgctctcattttctggtgttctgggtagctttaaaagtatgaacactgaagtacaccaatgctgtcagttataaaggatttgtattcatttctgggagctaaaaacagagatgctgctatggtttggaatcatactgctcatctcttgggtttaaaaaaaaaaaagcttgcggcaagattattttttaaatcattccacatttatcttcataaaacaatacaaagtgaattgccaaataagcatatatgacactttaatttactcatctattaaaactgtttcaatttaaacatctgaatgaataacagtcattctcctatttgcaatatttttcaacatgaggtgtgctcagtaacatcaacatacatcaagtataaccattcactgatttatttgttaacaaattcttattgagaacctactatgtactaggcagtgttctacctgctggggatacagacaggaataaatttaatcaaagtcctggttctcatggagcctactgcctattgtggggtagtggggatgggggtaggagggattaaacaaataaatgtataatgtgattttagacagacataagtgccatgaagaaaaacaaagcagtgcaaggctagaagattggcagtagagtgaggggtggggcttttttggatatggtggtcacagaagacccttataaggaagagacatttgaaaagagaccaaactgaaggaaaggagcaagccatgttgagacctgggtaaaagctgaccttccttccaggcagggcaaagactaagtgcaaaggccctaggctttggtggtttgataaacagcaagaaagtctgtatggctggagcagaatacttaagctgaggagataaggtggaggaaaagggcaggactcagttatgcgactgaagtctaatggaccattatataacatagttttgagcaagagtgacatgtcacactaactgaggttcaagggagctactctgggagacacaagtggacagaaggttagttaggagactatgtcaatacatagagcttaacctgatatcctcaaaatgctttcaccctttaggttttacagggagggtggaaggtaggaaactactttttaaatttcattatatctaaacaaatacacgtaaagtcatgtatacacgctgtaacacacattcctctcagtgactttgttagtcagaataactgaagagtattgtttcagataatctcagtcaagcagccttaaaatcgtgcacaaaacaagatgaccatcctcatcccttttattataactaaatgaaagtcatgtaagactgaatagttcttttgtccttaaacaggctatccgaaaaacagaagcatactgtctttcattgtcaattcatggttcacaaagcctctgaggttggctttcgtccttcaaaagcttttaatggacaggtacatttaagccttattttaaggattgtgagaaatggaatgcactgggagcggtccccatctcccttttatgaaaggaggaagatatcagcaatgcagagtgacctcacctataaggaatgcatcagtgacatggaacaaaggtggcttccttcgtaaggaaacccaatctgtttcagaaaactgcttcattacttttgactgatttagggctgcgcagcctactagaaacaattccattctttaacctctattttattaacaaaactgtgatatcattcttccttcaaacattaaagaaaagccttgcatattcatcaatcaaaactatattttattcagatcacctttgatcatacatgtgtttgtgccaactaagtgtatttttcagttgaagcctataaaagataggtggtgtgcctacaagagcgaggactctggtatgttccgcagcgactcaagaaccacgtgagatgtgctaggtaaaggcaattcactcttgtttcaggttgcacttaagagggcctgcgttttcacattttatagcatgttgagttttccagcttatgaattctatcacagcttactttttcaaacagtgatatcaatgcaaaacaagttctttgagaacagaatgaattcattcatggctaacccagatgcaacaaacaggacacagagttgctaaaatattacttctctctttcaagattataaaatatcttgtcacatatttttccccaaggtaatgtgtcaaaaatttactttctggagtcagatatacaatattccataggatcagcttttaaaatgttttcatgaccattgaaaagggctatgaaaattgctactattctcattctaaagctactgatagataagatagttgtaatctaattactccctaccatctggcacctgggtgccaataattagcaactctgcctgattgccagataatagtcaactgaccaggaaagttggttttaagtatcaaactgtgaatcaatttttgcctcaatctatctttaaccaacctattctatttttttggcttaatatcccagtatgtctagtaatgctgccaagaaacgatgaccttcagttcagggacagagaataaatacgtgctgatggactgacgtattcataagcaaaacacaggctcttttttcatacattctaaatttcaacatatatcactgaacataaggcatgttaaataaatcctaaactggcaacaacccacagtaacaggcaggatgggtggattatagcaaaggggaagttaaacaaaaatatgactctagctagttgttaatgataaacaccctctgcccaaatactgacctgataccatgaaactggatggagaaaaaagccctaggggtgggaggtgggggtgactgagaaatttacatatcaggttaatgtgaaaaataaacttgcctctcaaggaaaagtttggatcgcaaagaagaaacttaaataaacctagtaacacatgagaatttacataataaatattcacatagaattcccacttcttacacacaaagctcttcattcatagcatacctagaaaccacagcgtggcacatttctaaagttaccaaaccttcctagcatgttgcttctcaaaatctgccattcttcttaatccataaggaaatgttaggtagacctagtgttacttatttgtaagtatcagatagcttagtctcctgagagaagtaataactcaaggtatttccatgtatatagttaaattgttgatacattaacaatcacagagaatccagccttgcagctttctgagctagagagcccatgggcttttgtcatgtttcatatcacagctggctggcttatgatttgagacttggaaaggatcccttgggactaatttattctaactgcccttttcttccctctttccgctccattctcaataattttaatttaattttgaatgtgcatgttgcctctcataggattcaaaatgtagaggtgctattgctaaccacattacctgtgcttcctaccatccacaggattacccacctctggaattacttagtatacagatgatctgcatcaaaagaagccattatacatgtaacattttgcattctaaaagatttgcaagcagagaaattataaggtgtttggtaaagatcaacatgacagttggacagccaattcctattagatcaatttcattttcctctatgtcagaatgatgtgcctgggggataggagataacatatcacatattttaacttttataaggcttttgactcaactcagcagaacattctttctaataaactaggaaaacatgatttctagaccaccatggtgggtgcaaccaaaatgtttcaagggccattctcaagagaattgttattcaatatccaattacagtcaagtttcataagggtttacctagcctttgagtactactgtcattgctgacttaaatagtgggaagatgaatgtgaataagcttaccaaaatatacatgtggttagacactccaacttacaaggatgtgaatgtgttccgatggaccttggaattctggaatgtgagtagtcatctatcagttccatcaagaagtatttactgaactgaccacctactactttttccacagtcatgagcagaaaagaggtataaaattcaaaagagctcctgatctcaagttccttataacttggtacaggagacaacactaaagcacaattaattagagaacaataccaaatggggccagagaatattcaaaataaatgtaataaacaaggtatatatgtgtttaagatcaggtatccatatgatcacaaatatgtattaaagcaattgcattttggattggcatttttcaattcctgttgatagtggccaattgctgacactatcgtaaagattacagaaacaagtttaatccggagggtagtaaaaactaaccactcgagagatgggggaaactgaatttatctaaggaaaagagaaaatctgagatctaggcaaagcatgaaccagcaacgtagtgagttatttttaaaggtacataacatgaggatgtaaaaacaaggagcaggagggtcccatgacagcccttccacaacttgaagccccattcagaactttatcaccacactaagagctcttctggacctgaacccaagcacagcaagcaggggttggatagcgtccaaaggagagtgactaaaatgattaaaatgttaggaaatgggtcctatgaggacatgtaaacgaaactcagttattcagtccagataaaaagagaggaggtcagggctgcaccacagcctgcaaggtcaggaagaagaggtacaggggagcacctcttttccattaaggatgggatgaaaggaatgagagtacattgcaaggacaggaatttatgtttaacagaaaaaagaacctcctctggctaggaagatggtaaggcactggaataagtttgtatcaacaagcttttgaaatgtcctttagaagagactttctaaaaacccagtagatgaccattttcaaaaaatgttcacccagtgtcgtttcttacccaaaacagtacatgaatattttagctacaaaatcagtacgtgaatattttaactataaatagaaactccattaaaaaatatataaatttattgaaatttgaagcatagcaaggctcttcactgttgcagcatttgcaaaatgcatcagtaaagtacataaatgcatttgtttatatctgtttatatatgtcacaatttttttaaaagggaaatcagctgctctagatatgagctattaaaaaataaccaaaacatggaaaaactgaccagtaataactacttaagccacataatcttaatggtatggaagtgaggggaagggtgggcaaggttggggaagggtaagcaaaaatcagtcacaaaggaataaaacactacacacatgtgcatatgcatggatacatacacacatacatacacacatacacacacacacacacacacacacacacacacacacacacagagtccagatagatcaactgacccacccatccatccatctatccaacagtgcattaaaacatccatgttttaacaatgggcataataatctttcctaacattactttttttttttctttttgagtcaagagtctcgttctgttgcccaggctagagtgcagtggcgtgatcatggctcactgcagcctcgacctcctggattcaagcgttcctcccccctcagcttctgaagttgctgagagagcaggcacgagccaccatgccaagctaatttttttgtttttggtaaagatgaggttttgctatgttgcccaggctggtctcaaattcctgggctcaagcaatccttccgcctgagccatccaaagttctgagactataggcgtgagccaccatgcctgggctccttaaattttaaaaattaggactgcactacaaagcacatctagtttcccttacggaaagtcttaggagtctaagtctttagtaatatgctaaagaaataactaaattgaatttttttaaaattacttgagctattattttccccaatcacagggaaggaggcagagaaggaagaaagggagggaggcagggagggagagagaaagggagaagggaggaagaaagggaggaagggaaggaggaaggaagggagggagaaatagagggagggagggagtatagataatgttgctctccatttccttttacagatgaggcccagagaagctgactgactcaaccagtgtcacactatagtcgtaaaaccagaactatcttatgtagtcactaatttatgaacagcttgggtatctgaagtttaagccagctgtttaaaacagaacgaaatgttctatggtattaacatataagtgttaattaattaaattaccagactacatacacaccaatagtctgttttgtttgtttctttccttctttcttttagagacaaggtctcattctgtcacccaggctggagtgcagtgacaagatcacagctcactgcagcctcaaactcctgggctcaagcgatcctccagcctcagcctcctgaggagctcggactacaggtgcatgccaccatgcccagctaatttaaaaaaaaaatttagaagggggatggggatccgactatgttgctcaggctggtctcaaactcctggccacaactgatcctcccaccttggcctcccaaagcactgggattacagatgtgagccaatccacttgccccagagtttattttacaatataactgtgatatggtattaaaagttctaatttctagaaagagggaaaactgaagatactaatgtttactgagcatgtactaggtcttgggcatttgagattccttatctcatgtaatcctcacaaacttggaaagcagctcttcatcattctacaaatgaagaaattaggtaaggaagtaacttgcccaagagccacacagataacaaggaacagaggaagttctgcctgataataaatctcctgcttttcctattaccagacactttctgtccagcaggaatcacagagcacacaaaaaaggaacattcagaggaagaaattaattcctctgcatttcccctgaacacttttgaaaagttctgtactctctggcatctcccctatgcttaatgaatcctgttttctatatcctgtgctcattcacactgctctcagctagggtaaacttatggccctgttcgcctcagacagtcctgacttactcctgttgactctgcaaaattatcaacaacatccttttcactctcaaaaatgtcccagggtagaggataaacgacatggtcgctctgtctaaacccctcactacagcttcccccatccaggcttgcctgacctcaaagcagctcagttacctgcctccccgctctttcagcataataaatgccctgtccatcaaagtaggggttctcacatcagtaaaaactgagaaaagaaatatggttaggtaattctaaatatggttctaaagtgcaggacattttaatatgcagacaatctctaattgttggaatttcaagcagtgtaacaactttagatgaagataataatctggcagaacagaggtggataattctagcagatgagatctagcaagcaaaccagccctatttagagcttaatccaaagtcaggctccctaaactgtccttgcttttctgctctacctcacttctaaatctaacagttcatctgaaggctcctgtggcaggcacagtgtgggcttctaagggaacattaaaggcagattactggtgtcaatgggcaaatgtgagagccacatgtcacctcaatgcaccaagatcatatccaggtgccaatctgagtttgtcctaaatgtttgatatcaaagttggcttttgctacggtaattactttttaaatttcagggctacaaaagaactcagatatcagaaaagcctcattttataaaagagaaaactatgtcctacagaagagaaaacactggcctcaaatcacatagccaggactagaaagcaggtctcctcattctttccaccatataggtgattctcagcttccacacatcatatattttcatgcttcatatatggagacccagtacttttctgctgccagatttgaactttcttggaacagctgctatgtaaacatttcaagctgtcacactttggggcctttaaccaacacttcagcttcagcaacatcacaggctttgtacaacagtgttaacacttccagtgtcttcttaatatttcagacttgttttacaaaaatgagtagaaaaaagaaaaataaaagtgctactatagtacagttaagacaggaatgaaaataatacgatctaccaaagatggcaaaaatatttagcctcagacttcaactgtggcagaaaaaaagcatatgaaatgctgaaaaataatcatcactgtgcataaaacacaagttcaataatggggaaaaaactgttcaaagattttgaaaaaaactgaaataatagagattagtaaactaaatgtcactctggataaggtgggcaaatgaaaacttaaggtctgaaatctagttttattatataatgtttattctatgtgtttgtttttaaaaacttttaaagttttttaaggatatttaaaaactaagcagttatataattaggaatgtaagaatattttttagctctacaagaattgaatctccttataacatatctaatgttcagcttttcaacattactgctcacatttccaggaactttatacaaatgctagggatatttgtatcccacactgacactcttacttacattgctacggtattattttggggtacttcacataaattaaaactagatatgaagcatcctatagctaactttagctttctttctgtataaatgttgattgcctaggaccactcattacatattaaaataatgaaaattcactcctgttcattcattcctgaattgataagcagttttttctggcaaaaaataataataataataatttccttaatccttaaggaatttatttccttaggctaacagaaaaatgctcaacattgacagcccttgcctttctgcactacgtaacttaaaaattcatttgcacatcctcctactgctcacttttttcatgtttcacaacgcaaataatctactatttaactgctctgtcagccatctgaaatggcacctccattcccttcccagctaccccgaaagagcccactcacacatctatctttaaaatggctgtgtttacagccacccatatgtcaccattcatgaagcaactgctaccatcctcttgactaggcattggcagacatatacgcgacaaaaggattgcagagccacgaaaaagggtgcctggggctctgaatttttctttttaaggttactaccttcagaaaaaactaaaaatcaaaatttgtaagagagcagaagatacatgtactctttataataaaagctttgggagggtgagggagttgaagtttctaaatgagggagccttaccagcaaggcagcctccaagcataatatttctatcatatgtacacctcactatactatgttgctatgtaaatgaggcttgcctgctatctgagttcctcactatccatactatgtcgctatgtgtagtatttctatcacaagtacatctcactataatatttgtgctaggttgctacagtattgtggatccttaggaagaatcctgccacagcatgaattacaaagtcatttgccttttgaccttaaaattttaaagtctttttacatattgtcttgggtttgcttaaactacattaagcaatatactagagaggggatagattaataaatggagtgagcgtctgaccagagtggaaaaaagcaggcattcttcccaatagagtgagttaaggaatggaggtgtgcaaaggagagctgggggctcgtggaatgctgagaaaagaccacaggcaacagcaaaatagtcaggggcttgaactgacatactgcccctactcacatgccttttttgagcctctgattttattcttttgcttttctgagaccagagacttaattatggggcaaaacaaaaacaaagcattttgagaagacaacccagagaagcagttttaggaaggcaatggagaaggactgctttcctgctccccctgtctgttctaccggctccccactgcgcctcttttagccacttggaaagaacagaccacagttgcaggccagggcagtgcaaggtgctgcaaggcagagaagttaacactcaacacaggttctatagcagctgatgcaaaagccagggatgaagtgctaaagccagagagccagggcagaggtggaacttttcaaagaaactcaagaacaagacggacctccagctaaagcaaaactagattttatctctttcctccctttccctcggattttccttttccctgcccagccagcagtaacagaataatttctctccttcagtcacgcaaaagagaaatataaataaataaataaggactggagcaatagtgataataaatgaaggaaactgggacgggtgggggatcagggttgccaaagagatctgcatcaggctacttttcacacacaggaaaccaacataactgagttcatgtctgtattttatgtagctctacagccaaacactacatccactttataatcttttcggtatcttttcagtaactttggttctcatcatcccaaatagaaatgaaattaaatatacagctaaggatccctagagaggttggtactccactcacttattcactcatttattcaacaaacctcttgtgagtgtgtactctgtgccagacactacaaagggctctgaaaagtcaaagatggaccaaactcagccccctcaccagccccattcccacaaccactctgcatggagcttaggtccctatggctccgcatctttgagctgaagaaatgaagcccagagaaaccccacagccagcccatggcagtgttggaaccagaggccacaacttctgacctccaaaccacactcttccccatacatcaagctaaggagagtctgctttcctggtccactgtcattgtaaaggagctttatttgtcctctttttgtcaaaacaaaataggaagcaaggacagtgaggaaagaataacctctgccagctgcaactgagaaaagattcccctgctaaaagcaacatgaggtcccagggaaaatgtttgtcacttaagtcaactgcaggtaagggaaggaagcatttgggatcagaaattggacaagttatttaaagtctttcagccacccctcctacatccatgaaataagaataataatgtatagtgagccgtaaacactccaactgcactccaacctgggcagaagtgagaccatctcaaaaaaaaaaaaaagaatgcataatagcttcttatagatcaatgtgagtagatacggaagctatccaagttttatcattaaattaaaaaccacaagttgcagaactgcatatacaatgtgattccatttctattcaattttttgtctgaaagaaaacacaaaaaaaccttgtgacagtggttacccctagagattaggaacaaaggagtagagatattggaagccttgattttctcctttacatcatcttctactattacatttcttaccataagcatgtattatttttaattcttaaaacaaagaaaaatactatgagtatttttcttacactgagtattttttaaacagaaagaaaaatgctatgagaaaaatactatgaagaaaaattctatgagtaaaaatactatgagaaaaatactatgaaaaattaaatgaatggtacacataattagtacacttttctatgtgtatattatacatcaataaagagttttttcaaaaactggagtaggtctatgtgcttaaacatgaagagatttcatagatatagtaaatgaattagcaaatcattgaatctccagagcatgaaattctagttctgcaaaaaatcaagaaactatatgcatacacatataaatgtatatgaaaagatctgcaagtatatacacacttaataacatattcttctatatggttgaatttttttttacaaccagaatgcttttacatacattttgaaatctacattctttctcattttaaaaatgataacacttaggctgggtgccgcagctcacgcctgtaatcccagcactttgggaggctaaggtgggtggatcacttgaggtcaggagttggagaccagcctggccaacatggtgaaaacccacctctactaaaagtacaaaaattagccaggcatggcggtaggcgcctgtaatcccagctacttgggaggctgaggtgggagaatcgcttgaacccaggaggctgaggttgcagtgagctgagatctcaccatcgccctccagcctgggtgacagagtgagactctgtctcaaaaaaataaataaataaaatgataacacttgaccccagaaagctgttgtgaggtttacatgattatggttacatgacactttatgtgatataaaaaagaatcattacttttttaaaaaaattatcaattagtatgcaccacagaccccctttcccataccttccttctaccctgttcaagatctcatctccgagtctcaccatcaagcctagctcaggaatgaagtaaaggtcagggatggggcagacatgaagcctggagtaaggatcaaggatggataaaataagaggtcaagcatgcaacaaacatggtttagccaaaacaaacaaacaaacaaaacccaccttttccgttttaattcaatcattctgaaacacacagaaacatttccctcatccaaaccaccacattaaatgtcttgcttgggtccggtatgagttaatacacatccccatccccatctgtgcgaagacaacaactcctttgtccgtcagtgtttgtagtgaaccttacacgccaggggagcatgtcccaaccactctggtccacacttggtattctttgaccatgcacttaatccaaggaccacgaactacaaaaaagaaccccatcatagatagagacttattctatatcttatcccaccccctgatgcttcactatctgctgccttacttgttgtttcttgtgtgttacctcccccaaatgtaaactttttcaacagaaacatgcattaatgtcatctttgacctagtatagattattgaacataactggacctgaaagctctctacaggtgcttgttcatagatggatgtcaaagatgtcccacggcacagttcacagctggcagttgctttccacaccaaacctggagcaactcagttgtcctaactttctcccactacttccttcaattctttctgccaatgccattccttggaataaagcctagaatgccttactagggtgctacttagccctggaaagcaccaagtaaggatctgtatctggtttgtccatcattacctatcccttgagtaatgccttaggtactactgagtcctggaaagcactctctccagactccagctacagatcaatccaatttgtcagagataagaaagtagtagttttcccctctcaatatttccttcatttcctccagaactttctgtgcatctggtatactgtcacataaacttcaacttccttataacatgcctgtctattttaagaaattatgccaggcaatgtgggtagttgagggagtagggaggggctgaacaacttctcaaaggtattccatgacagaacacagaaggctggaccactgccagtttctggggaaaccaggactgaagggattggcagtggaccgagaggccactcaaggggctgacctttaggagtatgtctacagtcagagtacaagttggctagggctactacatccaagggcacagactgggtggcttaaacaacaaaaatgtatttcctcacagttctggaggctggaagtccaagatcaaggtgtcagtggggttggcttcctttgaaggcaactctccttggttggtaagtggcatcttctccatgtgtcttcacatggtcttccctatgtgtctgcatcctcatctcctcttcttataagaacactggtcttactggattagggcccatgcatgtgacctcattttaccttaaccccctctttaaaggtcctatccccaaatatggccacattgtgaggtactaggagttagaacttcaacgtagcaatgttgggggacataattcagcccctaacagtcagcaacagggaaagagggagaaaggaggtatgactgtgctatggagaaatgaaagcagacacagcatttacaggggaaaataaatttcatgtgtgttccctcatatctagaattccctacctttctttcccgatctctccattctttgacacaagctccaatcccgtatctgttctgaagccctgctaatcgtctcagtcccaatggtccctctttcttatcccaaatgcagagcacttcctatctatcctacccatctgacccttcaccctacgtggcccttggggcagttcttgatgccttctacattatcaaatttgaggcctcatcttacaccatccctgtggcttgcctagttcacacttaccttctgtcagttcttcctaggaggcacatcccttcctgtttaggtcagcccctttgaaatattcttcgcctctgccccttccctgcccagcccccattccctaattaatatcatttcacccttaagatctcagctcagatgcctcttcctcaggaagcttttgaagatcacacacacaattcaccctcacgctaaatgcaggtctttcttctatcctctcccctagctttgtgtcttagaacttacttaattacatgcctgcattgttattattttcttaatgtgtctctcccacaagatggactatacattcaaaacctaatgtgtctctcccacaagatggactacacattcaaaagctaagaatggtttgtctaccattacctatccagcagctagtgtagtgcccggcacctaatgagtgcttaagaagtatttattaaataaagcaacgaataaactaagtataaattagtataaatcagggggtctcatgtgatctattttttggatgaataaatttgctgtgaagtagaggcatcatgaaatcattaagtaataatatctaaacagaaacatgcacagatattaagagaacttaatgttaagagatattaagagaacttaaaagaatttttttttgagatggagtttcgctctttttggccagactggagtgcaagggtgcgatctcagctcactgtaaactctgcctcccaggttcaagcgattctccagccttggcctcctgagtagctggggttataggcacgtgccaccacacccggctaattttgtatttttagtaaagacggggtttcaccatgttgaccatggtggtctggaactcttgacctcaagtgatccacccacctcctcggcctcccaaactgctgggattataggcgtgagccaccacacctggccagcttaagagaatattaaagagaagttaatatctatgcatatttatgtttacatatcattacttaatgattccttaaatcattggaactgcgcataaaaagcagaaactattaggtctaaattctataggaactacttaaaaaccatgctttccttatctaatttatatatatgcattttaacttctgcagctacatttcttaggccatagacaggtatcagcagtgtccctctccctatggctcattccactgcttgactttggcctaaaaccaacaggaattctttacttagaggtaaaaaactgatggattcccatggtgattccaatcccacactctccttttctccttcaaattaggcaggaaacactaaaattttgggaacaagatgtgcgtcacacattggaaatgttcaaatctgttgataacattcaatatactttggctaaacgcatgaggaggccacatggtcacagcctaaccaaacacagaacataactaataaactgaagcaacattccacgttatcactttcagctttgcacaacatatggaaacaggctcactgcaccacttggttgtgtcagaacacttaagggaggaggatgcacatttgggatttattacagtcactcacctaagggaagcgtccaaagaagtgccttacaatatccatgtggcttcatgttacagaattctcactcttaaaaggagtcttttctagaaatgtattgacctttcaggtgtttgaactatatgtatggccctgactgttctgaatatttgaaagcaaaaggtactagtaacttactgagaaagcttttttttaaaaaaggggggtggggggcaggggatgggggaggggtagcagggggaggggtcttgctatgttgtctaggctagacttgaactcctgggctcaagtgatcctccggccccagcctctggagtagctaggactgaagatgcaagtagctaggggctagaggcgagtgccacagtacctggctcgaaaaactattttaaactagaaaaaaggctgttctttttctaagtattgcatcaattgcatcaactcagactactgaataggtttgtttttgtcctccatcctcccccagcaaagtaacagacatatttcctgttccatccacctcaactattttatcccagttataaggctcaagtttagttgagtttcttggcaagtaatttttctcatgctaaagaagaaacatgaagtaaattaggaaaagcatataaaccagaaaaataatactaacatgatcaaaatctccaaataatttacctatgaagttcaattttgggagcttagcagttcagataaatgagaattacatagtcaatttccatgttagcaagaaaacttaaaattcaaaagacattaagttgagtgtttgagcctctccttaaattcctctttatcagtgaacaaacattcaatgcattcctcacaacaggtaaggcagtgtcaacaactaagatacagtattccaggaagccatgccttccctagtctaattaacagggaaacaaaacctttccaaagatgcaaatctacacctttattaagctaaacagacctacatcaggtgtctcagaaattatcaacttgatcactggttctgggattaaaatattcgagtccaaataagtaaactccataaaataaaggaaatctaagaaaagcactgtaagcagatcagtttcacaacatgtgggctccaaataaggaaaagaaaacctccctatcccagagttctcactatctttaaataaataaatatgtcaaaagaaacctgacagccttaatgatgaaactgttttctgatcaggttttccagtgattaaaatggtctatatacttaaatacttcctatcatttacaaaagatgagcctgagaaagtagtaggaaaactattctgttaaaactgcctggtatccacatctgcgaattatgggaactaatgctatcccaatgggcagttcctgtattaaatgaaagacatcacttttgagtgcttactgaagacatttgaaaaaaatattctcatctagattaattgttctttaaaagcagattttaccagtttggccaataatttagaattccttcttcttacaaaaatgaagttgttttaattactgatgctcttgactactttttatttttgcaaaaatgagaaagcacattttatcaggaatccatcacctgcaacataatttatatttattagaaatacctatatttctaataaatacagattatttatatatatttctaataaatacagaaattttgtgtgacagttgtggtagctgtccaaataattagcttcatctaaaattatttcagcccaaactcaaatcccaagaaaaatcatttcgatggaaatacttcatttcattcactataaagcccaacataaagctagatgttttagtgtagtcctaagtgacattttgttgctacagcaacgaaactctgctacctgtagccatgatttgttaagaattccaccaacgagtaaattctgtgctgtgtattcataaaaccaatagaatgattctaagcaacataaaaattaaggcttgatttcctatttatgatttacccacacacatacttacaacatatatactacatatgtactacatacatgtaattatgactctgagccccatcaaaatgataaaataccaaatttccattttaaaatgggcacagaacaaaagctggtttagatttcattcactaattgctacttgtttcccaaaatttatcttaaaagataacagagactatctagagataattttcaaaacaataaaatttattatttatatccaatctcattccaagatgggggaaaaaaatattcagaggtataatctatctgttccagtatgtatggtttcctaagcaatgagttgacttcgaaaacaccaagctaaagaataaagaaaaaatgtggacattaccacctttattcaccaaactacctctgtaggctacttaccctcactggggggctccaggattgcacccgaggctgctgtccgccctgggagctctgcagatcttttgagctacaattagccacagtgctgctctgagaccttaatgcatttgtgcagttggtcccacttcccccaccaggaccaggtttccaaggcctctgtttgatgccatccagaagtctgaccagcaagatgttactgggaagctcctcgacacccgagccaacaagagtcctgcactcgggacatctgagttcatttcgagaacctacgatccccagcaaacatcgcttgcaaaacgtatgctggcaaggcaagaccttcgcagaagcatcaaggcgctctagacacaccggacactccaaaagatccaacaaggctgattcatccatctttatctactttactgagaaaaaatcttcagaaatgttcatagttgtgtgcatcccttaaaatgactcatgtaacatccatttcagactttgctctagagtcatggggaaaagggggaaaagagaacatgagtgttgttatctagggaaaaagttcaaaggagccaagaatcaaaaagtacccaaaagtacactattccctgtctgaatagtgtagctttgctttggaatgtgggttcctaaactccaaagtcaacaactgaaaacaaaacaggctttctaaacaacgcaaaattaacccctaaagatatctagggattcactgggcaaacacaaggcacagagtattacataattcccgcagaaggatttatgaagtgcaataaggaacataatttcttaagctctgaaagtggtatcagctgccttaataaagtcttcaactcataggagaagctgacagaggccattgaaagtttcctctacctgaaatttacttttatatccaactaaattcccttttttaagccactttagcgtttaagaaaccatgcctcatgtaatcgctcgtggtaaatgatcccaatattaaatacatatgtttcttcgctgttattaaaaatagaactgtttaattttgcccaaccaaaaagagctgaaggttgacaattctaaaagacacagatttgcttgaaagcagctaaaacagaaaagcgcccttcagggcagtagttgataaactctgaaacacatttctgaacggcctgtcctaatcccattcagaaaagctggcaaaattatcaccaaaagaattcgacaatggaaggttggactggaaactgtgggcatatgaaaatgaggccattcaggaaaaagcaagccacttactgcgccgctctccccccaccgccaaaataaatgtaaaagtgaatgcccaggagaacgggagtaaaaagatttggctgggagcattaacagctgttcttgacaaagccggagcgggggagccccagggctgcacccccgctcccacggcgccaagcacaggtactcccaagcccgcagggaggcgcggcggccgctcgccgcagacacaccccggggccaggtgtcggcggcacccggcaggagccggtcgcggcctggggctgcggcccggccggtcccggcgtggggatctcaccctacagcctccctcatctccgcctccctttagctcaggccggggacacaaatccctctacacgactgcgggaagttttcaaggacttaaaaataaatgcgcaggcttaagttgcgaaactcagccccacagagtgccacggggaagcagctttctagcccagccaagataaggcgacagtccccagagagaccgcgccatccgggaagcagggggtgctgggctgcgcccggggagaccgcggcacggagccctggcagcttcctgcccggagaaggcagaggccgcgggctgctccgcttccgcaggtcctgattcccggcccacggggacccgagggcgaggggagagagagaccgacccagggcggggatgggggaatgtcgagaccaccgccttctccgcggctaggggtccgccgacgctgggtccccgtcgaccccgcgccggccgcgcgccctacctcgcgcctcggctcctcctctttgttcgcggccccgcagcggctgcggcggctgatgcagatgcggccccaccgcgctcgccgctcgcagtgtctctgacgccgcggcggcaccgggagactcctctctgctgcccccctcacgcgcgcacacacaccacgccgccgccgccgcctcccactttcccagccaaggagggcggaggaagaggaggaggaggccgggacgcagccggcgcccggggcgcaagggggcggccccgcgccacagcgccttccccgggagcgggcgcggcacctctcggagccacccgccgccgcgccggcctcccgcgctgaggtgacctgcgcccagtaccccgccggagcccgggggcgggattggggcggcggcctgagggggcgctgcaagagcctagaggatggggagcggggcccccaggggactacgaggggaaggctcggggacggacgccttctccctgaggagaacgcgcctgaaaaatggagccaccggacgggaaggcggcgggagtggaggctgggggaagcaggaagaagccccgggacagggtcccgccgcctcctcctccccccggcggggctgggagccctggacggacccttcctccccaggctgggcgagtcgcggcgcgggaggggctgggtccgcggaggcggcgggagcagccctggcgggaaccgatcccgctgcgctttgcgtctggttgcccaccccggacacttacttggtagagtcggagcgaagtgttgccccttagggccgagagcggcgtggtgaatcgatggggacagtgccgcggccacctgtccgcacccagccatcagtcaccccaggacccaaaccggagcaagcctggaggaccgctgaccccaaagcccaagactaggaaaacggtagtacggacttccaacccaggctcgggggctctgttatccctgccctaagtggggagaattgagtctgacctcaggtgggctggcaccgcaaagcacgctgagaggcgcctcttttatctgagcctgggtggctgccatcatcgcagtaatctttgttttggttgccccaagcacacacctgtaaaccgaagtggagttttgaaaaacatcttgtccataggttttgaggtttttcagtctcgatttagtggagaagcaagttaaaattttgtcactgatctaaagttgacattactatatttgcatttaccatcaatttacaaaaagttatcccaaatacccctcctcaaaggtgggcagaaactaggtggttataagaagaaagggttacaacagatgatgcaagaaatctctgcccagccaccaactaggtttatgatttgacgaggagtctcagtttatcctctagtctccagctagggccacagctaaaccattcaagacataaggatcacataagcctgaaaaaattatgacagctaacaatgatcactcactgtaaatcaggcactgtgctgaacatttttcatgcatcagttcaattctctcagcaaccctctatgtcatcttttctcagccttgttctaaatagattcatatgctgagagtcataatgtatgaaaaccaaaaataatagcccacttccccttccattagaagtgagcaaatacatgggcatttgagctgagaaagacgacggaaggaatgaatggaatggagaatttctagtccagtttgcaaactgaaagttactacttagttctgcatgtggaactgggcagatagatgaagatgaggctgaccagaagattacagtcaataaacagatagggattatttgcagttattaaaactgaagctcaaataggttaactttcccctggtcacacagtaagtaatgttgaaccaagactcagtcccagctctctggattccaagtccagttctctttgcaccattccaaggccctgtcttttgcacaggaccgtcatatccccaccctaggcaaagcaaagcagtgtgtctcttcccaagggaaagaagaaactgttaatcatgtaattactcgaaagcaagggacagtttttattgtgttcttattttggtttcctatgtatttttagagagcagcacacaaggtcatagatagaatggtgcagctcttgaaactcctggcaaaagaaaatcaatagtcacacccattttcttttcttttctttttttttttttttttgagacggagtttcactcttattgcccaggctggcacccaccacacccagctaattttgtatttttagtagagacggggtttctctatgttggtcaggctggtctcgaactcctgtgacctcaggtgatctgcccgcctcagcttcccaaagtgctgggattacaggcgtgagccacggcgcctggccacacccgttttcaaagaactgaagacagtgtgtcccaagactgcagtggtcgaagaatctggcatacatctcatgaatattatctgggatgtggctgcagttctttgaatgcccctggtgcatgttctatagtttttagaacacaacacttttattagctttagttactccagctgtaaagtgaagttttaggcaagttactttaacctcctgagccattttctgtcaaatggttgaaaaaaaaaatatctttctcagagtgttgtgggatgactagatgagacaacatgctggttctttgtaatctgtatatctctattaaagtcagatagcatcattatcataatctgccaagaatcacccaggcagttattctgggcaaagtcctttcttcccagggtcttaaaaaagtttgggataggccaggcacggtcactcacacctgtaatcccagcactttgggaggccgaggcaggtggatcacctgaggtcaggagttcaagaccagcctggccaacatggtgaaaacctgtctctagtaagaatacaaaaaaaaaaaaaaaaaaaaaaaaattagccaagcatggtggcagtcacctggaatcacaactacttgggaggctgaggcaggagaattgcttgaacctgggaagtggaggttgcagtgagccgagattgcgccactgcactccagtctgggtgacaaagcaagactctgtctcaaataaataaataagtttggtataattctagtaattgcaaagtcctgtcaataatatagggaaaggggcagttggggaagagaagcatgttcatcttttcatgtctgggaactgaacatgaaggaaggaatgtaagcatgttgtgcttaagatccctgtgactttgagtagaaccatgaaaaacataaaacacaccctgtgacataataatgatagcttgcgtttacacagttcttatcctcccaagacttcaaaggactttcatatatattatctcatctgtcttctcagcatccctcagaagcggtaaagacagatatgattatttccatgtagacgggaaacaacaagatgtagataagttattgctctaagtggtgacaaaaatcagatacttaaatatccaatccagagcactctttggtaaactttggtactatgctttcacacggatatatatacatgtgtctgattatcattttccttcaaaccttgtttcttctccagttgccatgatattggtaaatgatagcactcttcattcagttgttcaaactagaaacctaggggtcatctttgatttcccttttcctctccatcaattctgctagcttctcccaaaatatatttcaatttatacccactttcctttgcctccagtgcaagtttatttaagccaccatcaccctttgtctctgtccgtcctaaaccagcctctctgtttccactcttgtccccataatctcgcccagaatgtagtaacattcagagtgagcaacaaaaaatgcataacatatcagttactacattgctccaaactcatcaattacttcccatcatgcctgaaatttagagtcaaacatagtctttgtcttacaagactcactgccacttggaccctgcaccactgcatcccagcatagtactctttctgtcttctttgcagcactttttgtggtctaatttttttgattccttatttattgcctatcttctttacctgaatataagttccctgaagtcagtgactgggtctgtcttctttaccattacgtccttcacagccaacacatagtgggttccagtaactaattctcaaataaggagttaatcaagtatacagttacatttcttgctatcctaaatctacatagatatttagtacctcactgccctacagatgggaaatcaggcaagcaatgttccaagttccattgagagtctttcttataaactatcaatcagtaagtttgatgtagaagatgaggacacatgattcttgattcttcctcttatgtttcacagttaagctgcagaaacagcttaacaccagctctgtaacacagaacataaacgcaatgccagtttatctttattcaaggtcttagttaatgacgtcaccatcccctcagttccccaggcaagcaagaaaatgcagattatcttcagcttccccttccccccctgatccctccccctcctaccatccagatggatgatccagagagcatcagaagtgcttcttacatctctcttttcctcccaatccttatttcagtcctgcctatctcctacttggacaataagtatctgcttccatttctctctagtgtacctgattatggagagagctttggagtcaacgtttctacaacctactaactgggtgaccttgggcaagtttccagtcttctgtgcctgagttccccctgtaaaataggtataacaatactacctaccacagagtttttgtggtgattttatatacattaataaaaatgaaatgcttaaaactatgcctgacacatggtaagtgcttaattaatgacagtattatttttatagatccactacctaactgaatgactttgcaaatttctttaatttttttgagtttcaacttccttatctatacaaatggatataatatatactttgaaagcctgatgtaaaaaaactagggacaaaatgaaaagcctagtatagcaccttcctggcacttagtagggacccaataaaatgtttgtttcttgccttttttactacgtatctgtctgcatctgtttccatataattaggaagtggattggattttatctaaggttccttccagcgttaattatttccatcccaactgcacaaaggacatctaagggcaatggaatccccttgtataaagccaagtggtcatgaggcaccatagttgtcaggaaactgggctcttagagtcaggcaagcccagagaggctattttggtctgcagtagtgggaaggtggtgcaaactccactgtctggcaaaaaaatctgagcagatggaatatttataggcactccccaaggatttcagttcgatcaggaaggatgctaggaagaaagttagactgatgagtaggaggtaactgaactgcatcttcctccagccttcttgaaacaggtctgaacatttgagaagctgttttttgggttggtttgttttgttttgtttaagacagggtcttgctttgtcacccaggctacagtgcagtggcacaatatcactgcaacctccacctcccagctcaagcgatcctcccacctcagcctcccgagtagctgggactacaggcacacacaaccatgcccagctaagtttttgtatttttggtagagatggggttttgccatgtttgctaggctggtcttgaactcctgagctcaagcgatccacccgccttggcctcccagagtgctgagattacaggcatgagccaccacacccggctagagaagctgtgtttgacaatgaaatatctggagaaagttagagttctctatacggactaattctaacccagccttcagggagagattcttgaggtttaatgcaatcagaaccacctgaaacactggtttaaaattcagacgtgctcgcctcatccctggagagttagtaggtccagcctgggttcaagaatcaggtgattctcatgtacatgatgctgggaccacaaactgagaaacacaaaggtaggcttgtccagaggcacatttaaaaggaaataacccaggcactgaccagggaagctaattttaaaagggcactctagggctttgtttttgttgagaaggatatgggatctatgagccagagctagtttgctagggacaataggagagggattgagtgtggccacctccattcattccagtctgtgcccctcttccctgcccaccctccatacagcactcagcctctcctcttaataaatgctggacagatttttaaaggatatcagttttaaaagggagctaaaatattagcctgcccagagaaacacacacgctggccccagcccactccaggaccccaaatgtgaacagaggtcacccgtgtcaagcctcagaaggtcctgttgtttagtactgttagatttcaacaaaaacatgcctgaaaattagatgcctctaatatatttctgaccaaagttcaaagataaatttaacctatatgaggaaaaaaaaataggagttgttcctttctattaaaactaatttttcttgtcaaatgccattatcattttaaaagttcaaaccttgaagtggtctttttgctcacaagcaaactttacctaaaccaaagtattagggagagactagataaatatccatcactttatctaaccatcttcaggaaatgaaattccataatcttcctcggtaaccatctttatatattaaagattatttatcaattttcagatttctttctttctgatcaaatttaaagataatggtaaacttttctaatgcatctaaataggccagcttaaaaatacacacaaaaagcaaacatgtgcatggattcaccagaaactcaaaaattatgacccaggtttctttttaaattatagtgttaggcaaaggatgttggccgcctttatcagttttacccaccctaattcatatgtgtaatcaaatacaagcctatattctctgattccataatgagtagaaatgatcccatcataacattttcttctgtttatagctaactcttttatttatttatttatttatttatttatttatttatttttatttatttattttttgagacagagcctcactctgttgcccaggctggagtgcaatggcacgatctcagctcacagcagtctctgcctcccaggctcaagtgattctcctgcctcagcctccctagtaaatgggattacaggcgcatgccaccatgcctggctaatttttgtatttttagtagagacgaggtttcaccatgttggccagtctggtctcaaattcctgacctcaagtgatccacctgcctcagcctcccaaagtgttgggattacaggcataagccaccgcacctggccaacataactttaaaaattaaattccatcatctttttatgccatataaattaatctgatagagtatctgatacatttattacaaagctttccccatgtaaattatacatataataaaagtgctgagtaactcatcaaaaaatttagtaatgattgatgttactgaattaaacctaagtgtagcaatatagaaaataatgttttaaataatctttctcaaataatctctttcccctgtaattcaaataaaaggctgtagagtgtttaaaaaaataggaacccaagatgatatcagtccagttgacattctttctctttgacaagattgtagaagactaaagattaagataatttccttgttttccataatgcttttatgcaaaaatgatgatttgcataatttcttttcagtctcaattgaatttctgaagctatttttcaagcaaacttccacatgtctccagtgtacaccatctgtctcatctctctttctctccttttttaaagtattacaattatcttgtaacaggcactgtcaaatctttattccccaaggattctttcttttgataaatgaaaaggaactgtatatattgttatgtgtagttgtatgaatgtgacaggggttaaggaaaggttagatgttcaaagctgttatggctaagttgacatattagaggaaatgtgatcaggtaagttggccagagttttaaaatcagatccttcactataggaaaatgaagaaatgtttagtcaaaaggtcagggggagggaggatcttaaagcaaagaagaatttgaaaatagtctgtggcccatactacaaagcattaaagaaaatatggggaaaaaagagggatggctttactcacaagctgcaaattacttataaagcctattggcatttggaaatggttgatgcttttactaggagaatcaagttttatgtttacatagtaagtatatactcagcagtaacttccaggaaatcacatggattgccaagaaaaagtccttattgaagcattatttagaaaaaaaatcctgccaaaaacattaaagaggctttttaaaaattgaagttcacaaggaaatgcaatagatagaatttatgtagtactcagaatttacaactaatatattttatagcatttcataaaacttttatttgcaactcaatttcaatcaatttgtaaagctccaattactaaaagtatagttaaagttacagctttccagaattattaaagaatggttcgccttaaaaaaccaactcttatttggaggaaaacatttaaaatacagtaggtattggccaggcacagtggctcatacctgtagtcccagcactttggaaggctgaggcaggcagatcagttgaggtcaagagtttgagaccagacttgtcaacataatgaaattccctctctactgaaaatacaaaaaaaattagccaggcctggtggtacatgcctgtaatcccagctactcgggaggctgaggcaagagaatcattggaatccgggaggcagaggttgcagtgaactgagattgcaccactgcactccagcctgggcaacagagcaagactctgtctcaaaaaacataaataaataagtaaataaataaaattatatatatatataatatatatatagtatgtatcactgacttttgaaatagaagacattgaaaaaattaacatttacagatgactgtgagccatcattataaacatcagttactgtacaaatgtagtagttaagactatagagtcagacagacttgggtttgaatcctggctcaaaatttctacttatgtgactttaagaaagatatttaaccaccaggcgcggtggctcatgcctgtaatcccagcactttgggaggctgaggcacgtggatcaactaaggttgggagatggagaccagcctgaccaacatggagaaaccctgtctctattaaaaatacaaaattagccgggtgtggttgcacatgccgctaaacccagccactaggtaggctgaggcaggagaattacttgaacctgggaggcagaggttgcagtgagccgagatcgcgccactgcactccagcctgggcgacaagtgtgaaactccatctcaaaaacaaaaaagaaagatatttaagccttagaaactatcttaagaaactaagatatgagccttagtttcattgtctgtaaaatggagataatggtatctacctcataggttgtcgtgaagcttaaaacagataatacatttgtttgtttgtttgttttaatttttatttatttattttgagacagagtcttgctctgtcacccaggctggagtgcagtggtgtgatctcggttcactgcaacctccgcctcctgggttcaaacaattctcctgcctcaacctcctaagtagctgggattacaggtgtgcaccatcacccctggctaatttttgtatctttagtagagatgggggtttcaccatgttggccaggctggtctcaaactcctgacctcaagtgatctgccagcctctgcctcccaaagtgctgggattacaggcgtgaggcactgcgcccagccaaaagaggtaatacattcgagtgcttagtgtatttacatgggacttagaactcagtaaagcttaaccagtcctggtattattagtattagtgttggtattgccatgattattttgccttgaggcttttagtagcagttttctcttgataacactagaattctatatttttaaatcttgcacagtcatgccacagagtgacttttccatcaacaacacactgcatatatgatggtggtctcacagaattataatggagctgtaaaattcctgttgcctagtgaagttgtagccgtcataaagtcatagtgcaacgtgttaatcacatgtttctggtgatgctggtggaaacaagcctattgtgctgccagtggtataacagcatagcatatacagttatgtatggtacagaatacttgctaatggtaataaatgattatgttcctggattatgtatttcctctactatactttttaatcattattttagagtgtactcctacttattaaaaacaaaactaactgtgaaacagcttcaggcaggtccttcaggaggcattcctgaagaagacattgttatcataggagatgacagctccatgtgtgctattacccctgaaaaccttccagtaagacaagatacggaggtgaaagacagtgatgctgatgatcctgacagcgtgtaggcctaggctaatgtgtgtgcttatgtcttttttttttaattatttttttttagatgggagtctttctctgtcgcccaggctggagcgcagtggcacaatctcggcccactgcaacctccgcctccctggttcaagcaattctcctgcctcagcctcctgagtagctgggactacaggcatgggccaccacacccagctaatttttgtatttttagtagagacggggtttcaccatgttggccaggatggtctcaatctcttgaccttgtgatccacctgccttggcctcccaaagtgctgggattacaggcatgagccaccgcgcacagcctatgtcttcatttttaacaaagaagtttaaaatgaaaaaaaaaatattaaagaatgaaatcatgtcttttgcagcaacatggatggagcttgaggccattaacccaagtgaactcagaaacagaaaacctaataccacatgttctcattcataagtgggagctaaacaataagtacacatggaaataaaggtggaaattatagacattggggactccaaaaggagggaaggtggatgaggagcagggatttaaaaagtatctgttgagtacaatgctcaccatttgggtaataggtactctagaagtttaaactgcaccagtacacatatacccatgtgacaagcatgcgcaggtactccctgaatctataataaaataaaaaaatttaatagagaaaagcttgtagagtaaggatataaataaaatatttttgtatagctgtacaatgtgtttgtgttttaagctgtattattgcaaaggagtaaagagatttttaaagagtttataaagtagaaaagttacagtaagcaaagattactatactattggagaaataaattttttttataaatttagtgtagtttaagtgtacagtgtttataaagtctacagtggtgtacagtaatgtcctaggccttcacactcacccaccactcactcactgactcactcagagcagcttccaatcctgcaagctccaatcacggtaattgtccctagacaggtgtaccacttaaaaaatcttttataccctatttttactgtgtcttttctgtttagatacacaggtatttaccactgtgtcacagttgcctgcagtattgagtacagtaacatgctgtacagatttgtagcctaggagcaataggctaaaccatatagcctagatgtgtagtaggctataccttctacatttgtgtaagggtactctatgatgtttgcacaaagatgaaatcaccagtgacacatttctcagaacatatcactgttgttaagctatgcatgactgtacttagaaacttttcttttgttttctctttcttctctttttacagccatcagaagccgcccaaacctttaatggtgagggtttggaagtgccatataggaggaagagttttggagggcccactccaaccatactgctttgccagcacctttacttctctgatattgctgagctccagacccagatttcattgacgtgattctcattgtaagaacctgatcctaagtctttacacattcttggcctgtgccatcctctgatgcttgactcttacgtttggaatcctcctctcctactcaccacctcttcacccacttttggtaaataatctttccctgtagattttatctttaattcttcttggacctccgttctcacatttttttttctgagcatgttagtcacttgtcttgcttccaactgctggttttctcagatccagccttattacttgaggcttggcagcagacgatttcttctcactgtttccacagtagcagtctttctcacttagtttatccacactgctagcatctcagtaatcaattaacctatatcgtaagacttgtgagtagagtgatagaaattagtcaaaatgcaacaataccatcaaagttcttcatctcctttttcttttctttttttttttttttttttgagatggagtctcgctctgtcgcccaggctggagtgcagtggtgcaatctccgctcactgcaagctctgcctcccgggttcacaccattctcctgcctcagcctccccagtagctgggactacaggcgcccgccaccacgccaggctaatttttttgtatttttagtaaagacggggtttcaccgtgttagccaggatggtcttgatctcctgaccttttgatctgcccacctcggcctcccaaagtgctgggattacaggcttgacccaccgtgcctggacttcatctcctttttcttacctgtatccatcattccctcctaaccaatgtaatggctatgtggcttgctttcctatctttctacatgctcatgtaaccatttataaagcatatgtacatataaagaaaaaaagaggattcagctaggcacagtgactcaattctataattcccagtgctttgggaggctgaggcaggagaattgcttgagaccaggagtttgagaccagcctgggaaacatagcaagactctatctctacaaaaaaaaattttttttaattagccagacatggtggtgtgcgccagtagtcctagctactcaggaggctgaggtgggaggattgcttgagcccaggagtttgaggctgcagtgagctatgatcacaccactgcactccagcctggatgagacagtgagaccctgtctctaaaaaaaattaaaaaaaaaggattctgttttatacatatacatttctctgcatcttgcttttcctctctaaaactatatattgtaagaatcctattcagtcaactggcatagagctgacttattctaatggctgcatagttttccatgagatgattgtatcccaatcatttttcttttctttttctttcttaattttcttttcttttttttctttctcactctgtctcccaggctggagtgcagtggcactatcacaactcatggctcactgcagccctgatctcccaggctcaagcaatcttcccacctcagcctttccaccatgggaggcacacaccaccgtacccagcattttttttttatttttattttttattggtagagatggagtctcactatgtttcccaggctggtcttaaactcctgggatcaagcatcctactgccacagcctcccaaagtgctgggattacaggcatgagccacacccccagcccgcaatcattttgctgttagtagtcattcattattttgttttttgctatgaaaaacaaagctgcaataaacattcctgtttctatatccttacgtagagaatggattcttcaggatggaatttgctggtcaaggggaatgcgtattcctaatggatgttgccacatttcataccacaaaaatggaacattcagatatctatcatgaaagcatgaaagtatccattccacattcccaaatcacccttgctggctgttgtgcttttacatttgtattactttggtaggtgcctcatgatatctgatatacatatatgtacatattatatatatgtgtatatatgtatgtatgtgtggttatatacgtgtgtgtgtgtgtgtgtgtgtgtgtgtgtgtgtgtgtttatttatttatttatttattttgagacagagttttgctcttgttgcccaggttggggtgcaatggcgcgatcttagctcgctgtaacctctgcctcccaggtttaagtgattctcctgcctcagcctcctgagtagctgggattataggcatgcgccaccatgcccacctaattttgtatttttagtagatatggggttttaccatgttggccaggctggtctcaaactcctgacctcaggtgatctgcctgcctcagcctcccaaagtgttgggattataggtgtgagccaccgcgcccggccaatatatatattggggcagagtcttgctctgtcacccaggctggagtccagtggcatgatctctgctcagtgcaacctcctgggttcaagcgattctcttgcctcagcttcccaagtagctggtattacaggcgtgcactactgccaggctaatttttgtaatcttagtagagacggagtttcaccgtgttgcccaggctggtctcaactcctggcctccagcgatccgcccatctcagcctcccaaagtgctgggattacacgcatgagccaccatgcttggccagtattttaaattgcattttttcctgactactagtaatctcttttaattagtttatttgtcagttgggttttctcttagttgaattgatcagtcttttttttttttgagacagggtccgctctgtcacccaggctggagtgcagtggcatgatctcagctcactgcaccctctgcctcccgggctccagcgatcctctgacctcagcctcccaagtagctgggaccacaggccgcgctaccatgctgcctggccaattttgtgtgtgtgtatttttggtagagctggggtttgccatgttgcccaggttggtctggaactcctgggcttaagtgttctgcccacttcggccttccaaagtgctggaattacaggcatgagccactgtgcccacccgtgaattgattagtgtttatctcctcagtttaataagggctttttgtatgttaaaaagttaaccacttatctgatatttgcattgctaatacttttcccagttggtaaatagtcttttcactttctctataactttttaattttaaacaattttgaaacactttcaaacttacagaaaagttgctagtacaatataaagaacttttattttcctgagccatctcagaataatttgccaatgtgatgccctggcatctcacagacattctcctacataaccacaatacaaccatcaaaattgggacattaacattcatatattgtgatcagtaaattttgctaataataataataatccccaataatatcctctagatcagtagtccccaaactttttggcaccagggactggtttcatggaagacaatttttccacagaccaggggtgagggggtggtttcaggatgattcaagtgcattatatttatcatgcactctatttctattattattacattgtaatatatgatgaaataattatgcaactcaccataagaatcagtaggagaaataattatgcaactcaccataagaatcagtgggaaccctgaacctgttttcctgcagctggacagttccatctgtgggtgatgggagatagtgacagatcatcgggcattagattctcataacctagtgcacaacctagatccttcgcatgcacagttcacaatagggttcatgctcctatgagaatctaatgtcactgctgatctggcaggaggtggagctcaggaggtaatgcaagtgatggggagcagctgtaaatacagaagtttagcttgcttgcccgccactcaactcctgctgtgtgacacagtaccagtgatggcccctaggggtaggggacccctgctttaagagaaaaaagccatcccattcagaagcacacattgcatttctttctcatgtgtctttaattttcttcaacttggaaattatttctcattcttgaattctttttaagtttataggccagatatattgtagaatttgggtttgaaaatattcctcattattagattcaaattatgcacctttggaaaaaaattcaatgaagcaagaagcaacattgtattcctcgtgtcagatggcacatgccttggatttgttgtccaatttgatagcttatttaagatgatgtcttttcttcttctccagcatgaatttatgttttctttctctagtattctttcaggaagtactttgaaactaagtaaatactctcttatcaaacttttaatttattcatatatttatatgtaccaatatgtactcatggttcttaatttccttcaaaggactatatgtgttactatcattaattcataattttgatgcttaatttctcccagtccagtgaaggaaaatgatagccagaaacacaggtgtaacaacaggcttattgacttagccgggcttaatagggtgtagtcagggaacagctttgttttcttccactcttgcctcaagcattttttgtcagaaacattttccttgctcttggtgacttttccgatagatcccatgagtttttcagtcacttcagattctaacaacactaccatttttagattatgtagttccatccaacctaaagtaaaacctcagtatctcatccaattcaaagtttatcctctctccctagctcaggcctgattcactaccttccatgccactggctaggaggggtctgattgctcctgttacctacctgcccccctgtattagtctgttttcacactgctataaagatactacccgagactgggtaatttataaaggaaggaagtttaattgactcacagttctgcatggctggggaggcctcaggaaacttataatcatggtggaaggggaagcagacaccttcttcacaaggtggcaggagaaagcgaagggggaagagccccttgtaaaaccaccagatcacatgagaactcactcactatcatgagaacagcatggggaaactgccccccgatccagtcacctccctccctctacacatggggattacaaattagagatgagatttgggttgggacacagagccaaaccatatcacccccacaaggctcctccagagttggggtgggcagtgtgggggcggggaagaaggcacgccagcagcactgtttgcacttttctcttgcctgtcatatgacctctctcacatcacattttcaaattctagttctttcttggtgtgcggcagttgagcctttggagatttccctgaaattttatctctttgggggagtcttacataagaatcagcttttagatttatttcccctttatactttgttttctgttcattaattttcatctttattctctcttccaaatttatgttttgtttattttggtgttcttgttctaaattttttaactggaccttaaatattttttaactttttttcctttttttttgagacagagtctcactctgtcacccaggctggagtgcagtggcacgatctcgactcaccgcaacctctgactcctggttcaaccatcatgcctggctaatttttgtatttgttgaagaggcagggtttcaccatactggccaagctggtctcaaactcctgacctcaagtgatctgcctgccttggcctcccgaagtgctgggattacaggggtgagccactgtgcctggcctaaattttttccttaataataaaatatttaaggctatgaattcccataggaataatttgaactatgttgtgtatattttggtatgaactttttcctcattgctttgtatatggtttgtaatttcagttttgtttacattttgataagagttatttagaatattgtttctttcttctttttttttttgagacagagtctcgctctgtcacccaggttggagtacagtggcacaatctcagctcactgcaacctctgcctcctgggttccagctattctcatgcctcagcctcccaagtagctgggactgcaagcacgcaccaccacacacagctaattttttttttctttttttctttctgtattagtaaagatggggtttcactatgttgcccaggctggtctcaaactcctggcctcaagtgatccatccacctcagcctcccaaagtgctgggataataggagtgagccaccgcacctggcctagaatattttttcttaattttcaagtaattagagggttttttgaggggtatcccttttcattacttactccttttattttcttttttggattataatcagggaatgtggcctataaaatctctactcctgtatattgacttagatatcctttggaaacaaaaacaagattaacttttgtaaatgttccattaaaacacaaaagaaatatagttatgaaatgtaacattccatacatgttttaggtcaaatttgttgtttgttttattctattcttctgtttctatttattttgtctgttagatatatgtgagtctgaaaaaggtgtgttaaaatctcctaacataaagattatgctttatatgtttagctactacaatgattggtgaacatgacttatgattgttatacctctgttatcaatttgccttttgtcattacatattaatatgcatgctgtttggaccgctaataggaccgctagacttgacttcttttgatttatatttatctggtggatctttttttttttttgagatggagtctcgctctgttgcccaggctggagtgcagtggcacgatttcagctcactgcaacgtctgccttcaagcgattctcctgcttcagcctcccaaggagctgggattacaggtgcctgcaccacacctgtataatttttttgtatttttagtagagaaggggtttcaccatgttggccaggctggtttcgaactcctaacctcaggtgatccacccgccttggcctcccaaagtgctaggattacaggcgtgagccaccgtgcccggcagtatctttttacatatcctctgaagtttaacttttctttctcactttgtttaaagtgagtttcttttgtttgtttgtttgtttgtttgaggcggagtctccctctatcacccaggctggagtgcaatgacatgatctgggctcactgcaacctctgcctcctgggtccaagtgattctcctgcctcagcctcctgagtagctgggattacaggcatgtgccaccacgcccagctaatttttgtatttttagtagagacagggttttgccatgttggccaggctggtcttgaactcctgatctccagtgatccgcccgcctcagcctcccaaaatgctacgattacaggtgtgagccacagtgcctggcctaacgtgggtttcttaagtaatatgtgtttgggttttgatttttaaatcacaccgtcagttgccactagttattatcctactactttctgatattaaagttgtagttagaaatctaaagccagtcttaatctttttctatgtaaacaatttgttctttctatctagaagactgtagaactttgtcattacccttggaattacaacacagtaatggaatctctagtgtgttccggttttcatcccctgttccttgaaactcaaagaattctgaggatgaaactctttctttagctctgtaaaattttcttcacctgtttgtttaaatattgtctctcctccttcgattgctttactcttctgaaattcctatttatttacaagttacaacttctagatccatcttctggttcctttatatttgcttttttgatgtctgactttaaatgtttgcttttttgagagatttctttcccttgtacttccagacctctgttcacttctcaatagttaccatacactttttcagtacatctgctatatttttaaacttaaaaaatcatgttcttgagttccagtttaacgctgtaattgaagctcctcaattgcactaattactttttctgttcaagttgccatgccctttttcagcagttctattttgctggcaaccgccatttctggatgctctgctcactcttccccattctggctttgttgttcctttgcctatgttattcacctggggccaggtcttcagcagcagctatctcttgagtacaggaggctccatggtctctgatcctgtagacagacaagtcctcagctggaaaatgcttatcttatcttctctgctccccagtttccttagctacaaaggttaattttctcttagttgtaaagatacaaagtcttttttttttgtttaaattttaaaaataattgagatggagtctcgccatgttgcccaggctgttctcaaactcctgaactcaagcaatctacccgcctcagcctcctaaagtgctgggattacaggtgtgagccaccaagcttggccaaagatacaaagtcttatttcattcgccactccttgagggccagagagaccagcaagtccttctaggtatagttgtgtcagctgtaggctgggttgctgggtagaatatattacatgggacagacttacataaaaagaattattcattattgatctaaaattcaatttttgttttgttttgtttttgagacagggtctcactctgtcacccaggctggagtgctggagtgcaatcagaactcacagcagccttgacctcttgggctcaagcaatcccttatcctcagctccctggagtagctgggattataggtacgcaccaccatgcctggctaatttttgtattttttgtggagatggggtttccctttgtcgcccaggctggtgaagttggaatttagctgtgtgttctttctctcttttgggtaaatttggctgccctaaggccaggcgtgttggctcatacctgtaatcccagcaatttgagagactgaggtgggcggatcacttgaggtcaggaattcaagaccatcttggccaacattgtaaaacccccgtctctactaaaaatacaaaaattagccgggcgtggtggcagttgcctgtaaccccagctacttgggaggctgaggcgtgagaatcacttgaaccctggaggcggaggatcagtgagcccgagatcacaccactgaactccagcctgggcaacagaaagagactgtctcaaaaaaaagaaaaaaaaattggtctgcactgatcagctgggttgttctccttcttgtcttttctcttgtctatggatcccatgggccaagctctcttcagtaacctcagagctctgacccttgcctcaaggtacctctcaggccccaagctctctctggcctgaaggatgctccggcccaggtccagtacaggccctctctgtattgaatccccacagcacctaaaaccctgcatgcccttccttctgcctcctaggctccatttgagaaggagttacagttacatggagctgggagaggaaaaggagacacagaggtgcacgttaggtagctgtggtagaatatgtgaggaaaatgattcttagagccagctaacctatcatttaagtaggaagacgggcaaaaatatttccagacctgaaaaccctcagaaatcctctttctcgagtatttttatgaataggtaatgtgaagatgtcctcaagcaaacaagagagtaaaacaagaaagaagaaaatgtgagcactaagaaaaagtcaatcccggcagggagcacagtgcggggccgttcccgagtatgagcggtgcagcaggcctggagaggagccaggtcaaccggagcacacgcacagaactccagaagggagggggccgcagacgaaacagcgcacgggagggaacggaagaacctaaggatgggatcaaagagaggcaatctgagtccttccagtcaacttttatttgagatgtgataggatcattcagggccgatcacatcagggatcccactcaaaatgtaccgtatttaggttcatatccccagggccaagttgaaatcaaaccaatctctgaataacgatataggatatatgtaaaaggccaatgaatgcgatacactctgctcaaattcagacacctgaggtctcaaaataactcatttcaaaacttggattcccacttttgtcctgcctccattcattctacctaaagaaaaccaaactaaaaaataggcttgtggttccagtctagcttataagaagttgctactgtttcccaccacaaataaaatgcagaacaaactgaaaaatcaacaattctattcttagatccataagagaagtgaagtcacagggcaaaccgctgcccccataatggagcaactgagcggaaacccacaagctgaaacctctcaggaacctgtgttggggaagggaaacctgaattgcaactgatgaattgctggaggctcagtgtggacaagtttgagagatattaataaatattccaggggactgagtccccctccaggagctcaaacagttcctcgcagtgaatattggagacgaatcctctccttctggcatggggaggagaaaaggaaccattttgaaatacgccagaaaactgtgttcttaacaatgcctgccctcaggagaaactatttaaccagagcctaacctgctggggtttcatcagaccctaactgacccagggaaaataaatgcccaactccaacccactctagccattcagtccacctgtgcagggtgggaactgagacacatctgtgaagttcacagtccagaggcacaggctgcctaaagaacagatacctaattgtgaaattatagaacacttccccaccccaacaccataccaccacattactaaaggctaatcgacagcagttccttttaaccagtgcctcatgtccagctatcaagaaaaaattacaagacatattgaaaggcaaaaatgtagtttgaagagacagagaaagcctgagaaccagcctaaaatatgtcagggatggtggaattattaggctggaaatttaaaacaactattattaacatgcttagggctgtaatggataaagtagacagcatgcaagaacagatgggcaatgtaagcagagggatggaaatcccaagaaagaaccaaaaataaatgctagagctcaaaagcagtgtaatcagaatgaagaatgtgtctgatggcttattagcagactgcacacagccgaaaaagaatctgtaaacttgaagatacctcagtagaaacctcccagactaaagagcaaacagaaaaagaagactgaaaaaaaaaacaaaaaaccagaacagaatatccgaaaagagtgggacatacacaaatggaaacaccagaaggaaaagaatgagagaaaggaacagaagaaatatttgaatagcaatgattgagaatttcccccaaattgtcttcagtcaccaaaccatagattgaaaaagctcagggaacacaaaacaagataaattccaaaagaaaactctacctaggcatatcatttttagactagaaaatcagaggtaaagaaaaaatatcctaaaagaagccagagagaaaaaactttgcctataaaggagcaaagataagaattatatgtgacttctcagaaaccatgcaggcaagtagaaagtggaatgaaatacttagcgtggatggaaaaaaacaccacaaacctagaattctgtgccctgtgaaattatccttcaaaaggtgaggagaaattaaagctttctcagacagacagaaattgagggaaattgttgccagtatacatccttggccagaaatgttaaaagaagatcttcagagagaagaaaaatgatacaggtctgaaactaccatctacataagtaaaggaagagcatcaaggaaggaataagtaagggaaagaaaatttttatttttcttgttcttaattatctaacaacagtttgttcaacataataatagcaacaatgtattcaattatatatacatacagattccagagaaattaaaagaataatcaagcaatactttgaataactctgtgtccacagatttgataacctagatgaaatggggataattccttcaaagatccagtctgccaaaagtcatacaacaagaaacaatcttaataggcctatacctcttgaagaaattgaattaattaattaataacttttcaaaatagaaagcaccagggccagatgggtttatgagtgaattctaccaaacatttaataaggaaattatatcacttctctacaaactctttcaaaagatagaagcagagggattacttcttaactcattttacgaggcctgcattattctagtaccaaaaccagacaaaggtattagaagaaaactacagaccaatatttctcaagaatgtggttgcaaaaatcctaaaatattagcaaatcaaatccaatgttatattaaaagaattacataccacaaccaaatcggagctatcccaggtatgtaagactgattcaacatttgaaaatcagttaatgcaatccatcacatcaacaagcaaagaagaaaaatcatatgattatatcaacagatgcagaagaaacattggataagatccaagaccatttcatgataaagactctcaataaagtaggaaagagtgaaacttcctcaacttgataaagaatatctacaaaagacctacagctaacatcatactaagtggtgagaaacaagaagctttcccactaagatcagcaacaaggcaaggacatctcctctctcactactgcttttcagcatcataatggaagtcccacctaatgcaataagtcaagaaaaggaactaaaagtataccaattggaaaaaaagaaatagaactgtctttgttcacagatgacatgattgtctatgtagaaaaaaaaatgaccaaaaaaaaaactctccacaaagccctggaactactaagtgattatagcaaggttgcagaatgcaaagttaatgaaaaattcaatcactttcccatttactgacaataaacaagtggaatttcaactaaaacaatgcaatatcatttactttaggacccctaaaaatgaaatacttcgttagaaatctaaaaaaatatgttcaagacctatatgaggaagactagaaacctctgatgaaaaaaacaagaccaactgaataaatggagagacatttcatgttcatggataggagaactcaacattgtcaagatgtcagttctttacaacttgatctataaattcaacataatcccaatcaaaatccaaataagttgttttgtggatatccaacaaacttattctaaagtttatatggagaggcaaaagccccagaattaccaacataatattgaaggagagcaaatttggagaactgacattatgtaagtttaagacctactataagctacagtaaccaagacagtgtggtatttgtgaaagaataaacaaatagatcaatggaacagaaaagccctaaaatatacacacataaatatagtcaagtgatctttcacaaaggagcaatgataatacaatggagaaaagacaggtttttcaacaaatgctgctggaatgagtagacatacacatgccagaaaaaaaaaaaaaaaaaaaaaaacctggccgggtgcagtggctcatacttgtaacccagcactttgggaggctgaggtgggtggatcacaaggtcaggagttcaagaccaccctgaccgacatggtgaaaccctgtctctactaaaaatacaaaaattagctgggactggtgtcatgcacctgtaatcccagctactcaggaggcggaggcaagagaatcacttgaacctgggaggtggaggtttcagtgagccaagatcatgccactacactccagcctaggtgacaaagcgagactctgtctcaaaaaaaacaaaaatgaaaacaaaaacaaacaaaaaacctagacacagaccttataccctttacaaaaattagttcaaactacatcacagagctaaatataaaacacagaaatgagtggctgaatggattaaaaaaaaaaaaagacccaacaatctgttgcctacaagaaacacacttcatatataaaaacactcaaagactgaaaataaagggatggaaaaagatattccatgcaaatgtaaaccaaagaagagcagaagaagctatgcttatgtgacacaaaatagattttcaagacaaaaactataaaaagagacaaaagtcattacatactgataaaggggtcaattcagcaaaaggatataacaattttaaatatgtatacacccaacactggagcatccagatatataaaaacaaatattattagagctaaaaagacaaatagacctcaatacaataatatctagagacttcgacaccccactttcagcattgaatagatcatccagacagaaaatcaacaaggaaacatctgacttaatcttcagtatagaccaaatggacctaatcaatatctacagaacactttatccaatggctgcagaatacacattcttctcctcagcacacggatcattctcaaggatatgccagatgttagaccacaaaacaagtctttaaaaattaaaaaaaaaattggccgggtgcggtggctcacgcctgtaatcccagcactttgggaggccgaggcaggtgaatcacaaggttaggagttcgagatcagcctgatcaacacagtgaaaccccatctctactgatataaagtacaaaaattagccaggcatggtggcatatgcctataatcccagctacttaggaggctgaggcaggagaatcacttgaacctgggaggcggaggttgcagtgagctgagatcgcgccactgcactccagcctgggtgacagagcaagactctgtctcaaaaaaaaaaaaaaaaaatttaaaaattgaaattatatcaagtatcttttctgactacaatggaataagactagaaataaataacaagaggaattctggaaactatacaaatacatggaaattaaacaatatgctcctgaatgaccagtgagtcaatgaagaaattaagaaagaaatttaaaatttttttgaaataaatgataatggaaacacaacatgccaaaacctatgagatacagcaaaagcagtactgagagaaaagtttacaacgataagcacctatatcagaaaagtagaaaaaaaataaataaacaacctaatggtgtatcttgaagaactagaaaagcacaagcaaaccaaactcaaacttagtagaagaaaagaaatcataaagataagaacagaaatgcaggaaattgaaatgaagaaaacaacacaaaaaatcaatgaaatgaaaagttggctttttaaaaagatgaacaaaatcaacaccaacaaactttttttcagactaagaaaaaagagaagaaatctaaaattaagtcagagatgaaaaaggagacattacaactgataccacagaaattcaaaagatcattagaggctactgtgagcaactacatgccaataaattggaaaacctagaaaaaatggataaatttctagacacttacaaaccacataattaaaccataaaaaaaatccaaaacctgaacagattaataacaagcaacaagagtgaagctgtaataaaaaatctcccagcaaagaaaagccctggaccagatggcttcactgctgaattttaccaaacatttaaaaaagaactaataccaatcctactgaagtattccagaaaatagaggatgagggaatacttccaaactcattctacaaggccagttttaccctgataccaaaaccagatacagacacttcaaaaaaagaaaactgtaggccaaaattcctgatgaacattgatgcaaacagccttaacaaaatactaggaaaccaaatctgacaatacattaaaaagatcattcatcatgatcaagtgggatttattccacagatgcaaggatgcaactaaagtaatacatcatatcacaagaatgaaggacagaaaccatgattgtttcaactgatgctgaaaaagaatttgataaaatttaacatctcttcataatgaaaattttcaaaaaaattgcatatggaaggaacatacctccacacagtaaaagccatatatgacagacccacagctagtatcatactgaatggggaaaaactgaaaggttttcctctaagatctggaacatgaaaaggatgcccaccttcactattgttattcaacataatactggaagttctaactagagcaatcagataagaaaaagaaataaaggcatccaaattggaaaggaagaagtcaaatgatccttatttgcagatgatatgcttccatattggaaaaaacccaaagactccatcaaaaaatgattagaactgataaatttagtaaagttgcaggatacaaaatcaacatacaaaaaccagtagtatttctgtatggcaacagcaaacaatctgaaaaagtaatcaagaaaggaattccatttacaatagttacaaataaaataaaatacctaggaattaaccaaagaaatgaaaggtatctacaataaaaactataaaacactgataaaataaattgaagaggacatgcaaaagaaggaaaggtatttgatgttcatggattggaagaatcaatattgttaaaatgtccacgctacctaagcaatctagagattcaatgcaatccttatcaaaataccaatgacattcttcacagaaatacaaaaaaaaaaatcctaaaatttatgaggagccacaacagactcagaacagccaaaactatcctcagcaaaaagaacacaactggaggaatcacattacttggcttcaaattatactgcagagttgtactaaccaaaatagcatggtactgtcataaaagcagacattcagaccaatggaacagaagagggaacccagaagcaaattcatacatctacagtgaacttattttcaacaaagattccaataacatacattggcagaaaggacagtctcttctataaatggtgtgggaaaactggatatccatatgcagaagaatgaaattagacccctatctcttgccatatacaaaaatcaaatcagaatggattgaagacttaaatctaaaacctccaactatgaaactacttaaagaaaacattagaaaaaatccctgggacattgatcagggcacgcatttcttcagtaataccccacaagcacaggtaaccaaagcaaacatggaccaatgggatcacatcaagttagaaagcttctgcacagcaaaggaaacaatcaacaaggtgaaaaaacaacccacaaaatgggagaaaatatttgcaaacttgccatctgacaagtgattaataaccagcacatataaggagctcaaatcactcaataggaaaaaatctaataacccaattttttaaatgggcaaaggatctgaacagacattctcaaaagaagacatacaaatggcaaacaggtatatgaaaagatgctcagcattattgataatcagagaaatgcaaatcaaaatggcaatgagattatcatctcaccacagttaaaatggcttttattgaaaggacaggcaataaaaatgctggcgaggatgtggagaaaagggaaccctcatacactgttggtgggaatgtaaattagtacaaccactatggagaacagtttgaacattcctcaaaaactataaatagaatgaccatatgatccagcaatcccactgctaggtatatacccaaaagaaaggaaatcagtatattgaagagatatctgcacttccacgtttattgcagcactatttacaatagccaagatttggaagcaaccaagtgtccatcaacagacaaatggataaagaaaatgtgggacatacacacaatggagtactattcagccataaaaaagaatgagatccggccaggtgcagtggctcatgcctgtaatcccagcactttgggaggctgagatgggtggatcatgaggtcaggagttcaagaccagcctggccaagatgctgaaaccctttctctactaaaaacacaaaaattagccaggcatagtggcacacgcctgtaatcccagctactggggagactgaggcaggagaatcacttgaacccaggtggcagaggttgcagtgagctgaaatcatgccactgcactccagcctgggtgacagagcaagattccatcttaaaaaaaaaaaaagaatgagatcttgtcatttgcaacaacatggatggaactggaggtcattatgttaagtgaattaagccaggcacagaaaaacaaaatttgcatgttatcacttatttgtgggagctaaaaatattaaagcaatagaactcatggagataaagagtagaaaaatgattaccagaggttgggagggggatggaggggaagtggagatagttaatgggtagacaaatgtagttagaatgaataagatctagtatttgatagcactatagggtgactacagtgaacaataatttattgtgcattttaaaataaggaaaagagtttaataggattgtttataacacaaagaaaggattaattctttaggcgatagatatcccatttcccctgatgtgattattatgcattgtatgtctatatcaaaatatctcaagaacctcatcaatatatacacctactgcatacttacaaaattttgttttattaaaaaaattagaaaaaccccacaaaactataaaagtcctgcaagataacataggagaaaatctagatgaccttgggtttgatgatgacttttagatataaaaccaaagacataatacaagaaaaaaagaattgattagctgtactttcttaaaataaaaaatttctgccctgcgaaagacacttttttttttttttttgagacagaatcttactctgtcacccacgctggagtgcagtagcacaatctcagctcactacagcttccacctcctgggttcaagcgatcctcctgcctcagcctcccgagtagctgggattacaggcatgcatcaccacacctggctaatttttgtatttttaatagagatggtttcaccatgttggccaggctggtgttgaactcttggcctcaagtgatccacctgcctcggcctcccaaagtgctgggattacaggcgtgagccattgcgcctggctgaaagacactttcaagagagtaaaagacaagctacagactgaaataaatattttcaaaagttatatctgataaaggacggttatacaaatatacaaagtactcttaaaactcaacaataagaaaacaacaacccaattaaaaaaatagaccacagaacataatagacacttctgaagaagatctacagatgacaaataagcttatgaagatatgctcatcatatgtcattaggaaatgcagcaagtgcaacttaaaacaacaatgagataccactacacacctattagaatggccaaaatccacaactctgacaacaccaaatgctgaatctgtattagtcagggttttgcagagaaacagaaccaatagatataaaagaagatttactatatggacttggctcacacgattatggaggctgagaagtccctcctctgtcatctgcaggctggagactcaggaaagctggtggtgtaatttactctgagtttgaaggcctgagaacaaggggaactattgatgtaaatcccagtctgaaaatgatatgagatgtcctagatgcagcagtgaggaaggtaaaaaagaggaggcagggagcaaattcctcccttctccacctttgttctgtttaggcccttaatggattgattgattgctgttgtggatgacagccacaatggggagggcaatcaactaaatccatggatagtcaaatggtaatctcatctggaaacaccctgacagacacactcagaaacaatgtttcatccaggtgcctctaaacccactcaaattgacacataaaattaatcttcacaaatccacccctgtcaacttggtacccatgcatacctccccaatccatattaataaagacaacaaaaagtcttaattctgcctaacataccacaactatcctgcaaacaatcaaaagcgcacaaacctcttccctaggaaaggaggtaaggtcctttagtgatacttaactcttctccttcgtatctcataactcagatactatgatgtaaagttaacaatactgaaatactgtgatataaaatcagtacatctaaggttacatgataaggcagtaagaaaggaaggaaaacaaagattatatacacacatattcatagcaacataggagaaaataatcatgacaattacattcctaactgatcttgtagtcatggtggtagccagtatttttaactatgggtggaggaaggaggaaccttctactacatattctgtattccctttgccttcagcaagctcctcagctggttgtgattcttctttggtgtggtgacccaaaattttattcctgaaggatttgggacattaataatcctggctggactgggtttttgtaatttaatcacaggatgcagtaatactaagagatgccccacgtgacctcctgtattccacatatgctctttctttggttgtggttggtctactacaaccaaagtagaccagctttcccttgggagtcaggatcaatcaccccagccaacaccatgactccctttcacgaggagacacaacaatgattccactgaactggaaggtaagaccagccacagtaggaactctcattcattgcttatgggaatgcgaaatggtacggccactttggaagacagtttggtggtttcttacaaaactaaacatcctcttcccatacgatccagcaattatcccctttggtatttacccaaggaagctgaagtattatttccacacaaaacctgcatacagatgtttatgacagctttattcataattgccaaaacttggaagaaatcaagatgtcctttagtaattgaatggataaatgaactgcagtatatccagccagtggaatatgattcagcagtaaaaagaaatgagctaccaagccaggagaagacatagaaaagtcttaaatgtctattactaagtgaagggagccaatctgaaaagacaacatactgtatgattccaactctatgacaacctggaaaatgcaaatctatggagacaggaaaaagttcagtggtttccaagggttgcggggagggaaaggtgaataggcagagcacagaggacttttagggcagtgagactactcagtatatcattacagtggcagagacatgtcactataaatttgtccaaactcataaaatatgcaacactaagagtgaaacctaatgtaaactatggactttggatgacaagatgtgtctgtgtaggttgataatttgtaacagatgtaccactctgttgaaggagattaataatgggtgagttgcatgaatgggggcacggggtagatggggaatctctataccttccactcagttttggtgtgaacctaacactgatctaaaatataaagcctactaaaaaaaaaaatacactcacatacatgcacacacacacacacactcacacacttttggctagtgaggaaaaactcatgtgtgtgtgttatacaatatatccctatctcttgatataaaaaaatagctttcaaaatttttgcttggggcctggtgtggtggtgcgtacctatagctctagagctttgggaggctgaggcaggaggattgcttaaggccaggaatttgagaccagcttgggcaatatagtgaagaccctgtctttaagagaccttgtctcttaaaaaactaaaaatttttttttattagttcagttccctcatctggtaagtgaagcaaataagagtaccttaaagaattgtggaattaaatgggttatatatagggaacagtgtgtgggatatggtaagcaccatgtaagagtttggtattgtaattaatgaaggacagcaatgctttatactactggaaaagctccagtataaaactggtaataggaacaatgtaaatttgtaactaccatagataattatatcactacgcaaataaaatgtgaaaaaaatttccttagttcctgtaacttggtagtagctgcaacctcagtgcttgctttgttggcatctacttgaagattgtgccaattagtgcaaacagaaaagtagcacaatggatttagagtcattttgttcaaaataaggcaatactttcctataaagcactgtattttactgtaaaaaaattaagaaaaattaaaagcaaactgaatatagatttagaccaaagagaaaatttaaatatttttgtgctgagagaacatgatgccatctccttctgggtagacaatgacaaggccctgaaatcctgtgagcatgaagtttgcttggataatgagattgtcactgtgacctcctcttggctcaaggcctcttgtttatttctggttttcagtcatgctcttggcatagctcaaatgctcaagaatatttatcatccctgttcatgtttccaaagcagacaggatttgctgttccctgccatgagaggggaatacagagtgaggacacctgctgtggggtgggacggggagggaggcgcctggtgttccctgggccatgtcttactaggagatagattgtatgtctcaggtcacaggtgtcccagactgtggttctagtgggtctgtgaccattagtcagcctgaacctcccttcacatcctgtcccctctgtgtaaagtattcctcctccctctatcttctcctttctagcaattgggaggatgaaggcagcttgaggttctctgtggctgctgtgtaagtggactaagtgggccctcaaagtctatttttcagaagggagcagaaaaccccaaaaggcttcatttctaagcttcatcctccaacacagtttcctggaaactctactcaccattaatcgtttatgccctgctccacacttgaccagcaaaactccgatctaaccttcctatttgtgaaagctctggagggaaagaggaatgaatgggagaagtcagggcctaaactccttcacatgcctaatgcttcatgtgcatcaaaccctacacaaaacatttggaagaggggaaggagggaggaggcttagtatttaatgggtacagaggtttcatttgagaagatgaagaaagttctagagaatggatggtactgatggttgccaacaatgtgggtgtacttaatgccactgaactgtacactttagaagggttacaatggtaaattttatgtttgtatatattttaccacaattttgaaaagatgcaactaaaaaataaccccaatatttagagtaagcaataagcatctgtgtatctacacacacagaggaatgaatatatttattcatgtcaatttcttattagaatgatcaaggtgattataaattttctcataatagtcccaggatgagaggcaagtataatactgtggagtcagatggttccagatctgaattctggctctgccacctattcagtatattatcttgggcaagttatctatttcttgagcctcagtttcctgatcttttagaggtatagaatcttacatatggcatcagtttcaatgaactaatacataaaggacctagtggcagatctggcaaagaagggacactcaagtgtttcattcatgtctgtgtttcccctttcaggtgcaatgcaagtgggtctacaggcaatgcccactcctgagaatcctgttccacttccaaggagctccaggagctctgtctgctctattgtgaatccaactcaatttgatatccccaggcttatcaaaaatcaatccttacactgtgggctcattattttataggaagactggagtcacactctatttacaaagtctttgaggtaagtgatgacctgttggaaaaatgcttatagttttagaattaccacacaatgcctctgacaagacctactcctgctgggatgaactggtttcatgtgtattagattatatgccaagaaatacttgccttaagactggcccaaaagccctgtcggtcaagactccaaatcaacctccaagcaggtaccatagaaatccaaacccttaggctggcccagcaggttgacttcagaggcagccaatctgtgtgtgtatctcaagcttggtaaaaacatgcaagtatgaaagcaaattgagccataatctccacaagttaaataataaagtaaacttcttatataagccaaatcatgattaacagctacactttgctatcagggtaagataatttgtgttaagaactcatgaaagtaatagaatcattctgtgatggtttcaagtattttcaagctttacatcctgtaattctaggctctctgggacaatgctgctttagaattccatccataggtgattaggtgtaaagtagctagcctatccccactgttgacaaagtgaggtcactatgagctgtcaacacagaaaagaaaggaccttaatacaacggctgctgatgttcaggtgtcagggagggtgtgtacatgaggcaagaacccagccgtgcaatgaaagcaagttggagacaggctgggatcagaaacctaatatattttaagactaatttattctaatggccacaacagataagccacattgctcaccaccaaacaggccactcatgaagcctttatatgtccatggtgcacagccagtagcatctattttgaaactttttccagaccaaaactatttctgccttgctttatagggtgaggaatccagggtctcagggtaacatttgtttaaatactaaggtgagtccaaagctgttcctgagaaaaatgtatatttatgtggccactctttgtgaatgtgggatacctttctactctgtcaaaatcataggctaggctccacaacttccgtatttgaagatcacctctataatcacctcttttggcttcctaaaaagagctgatttgaattagcaatagagaacaccagcactgcagcccttaccagggagcaaatggttaagctttttgccagctgatatggtttggctgtgtccccacccaaatctcatcttgaattgtagctcccataattcctacatgtcatgggagggacccagtggaaggtaattgaatcataggggtgggtctttctcatgctgttcttttgatagtgaatgaatctcatgagatctgatggttttataaaggtgagttcccctacacaagctctcttgcctgctgccatgtaagatgtgactttgctcctcctttgccttccaccatgattgtgaggcctccccagccatgtggaactgtgagtccattaatcctctttcctttataaattccccagtctggggtatgtctttattagcagcataagaacagactaacacagcagcctagtcttacaaagagccctattgaatggcaatattttgggagtgtcaatagagatgaagcatctagaattcagcaattctaggctctgtaaattctacttaattcaagttagcctgctgaacactctactgtagaacctatttactgagtgcttagtgctaaaatcatcttaactggcttacagttcagtgtttagcattcagtttttattgaagagggctgtaagtaccagttcctatgaaatctgtttttgtagttgttgcaaaagaagaattccatggaagccatgatctcttgcagtgacatctcattatacgtgcatttaacttatgtgaagcagatatttgtgcttggacagtgggtacagagagggaaataattgaaatgatgtaacataaaatactataaaagttatattttgcatatgttctattgattattatactgtataggtctacaaatattgtgtgtatgtatacttcacttaatcgacaatataaggagttttgttagaggaatttggattaaacatgcttttttcctcacatgctaatctggaacctaattcatgtggaaagccggtcatcatccgctggacatgacgattgacatcaccacttaagatgccgtctccggcctggtgtggctcctgtcaggcgaggccctggattccgtaagcagagttaagacccatgtgaaaagttcaccctagtaaaaggtgcagtttcttgcctcggtccaaacgtctcagcactttccaatcacatgttgggcaactctcctgcacagcccactttctagacctgaactctgcccacttgttagggcggctgtgtgctcagggcacaacctttggcttctgctgccagcccctgtgtcacttgctcatcagcttctcgggagcaggacctgtcttactctctgtttcacaaatgtttagtagaatatctggcacatagtaaatggcaaatcaatatttgtggaacaaaacttaatctgcatgtgactttatccttgttcccactgctgcattcctgagaacagagccactggtaacctcccattcagcaaacatcctttcctgtgtccagccttggaagtatcccttggagtaaatctctctgtaaagtccccttgcaagaaacactttttaatgccaggcacggtggttcacgcctgtaatcccagcattttgggaggccaacgcgtgtggatcacctgaggtcaggagttcaagagcagcctggccaacatggcaaaaccccgtctctactaaaaacacaaaaattagccgggtatggtggtgggtgcctgtaatcccagctacttgggaggctgaagcaggagaatcgcctgaacctggagggcggaggttgcagtgagacgagatggcgccattgcactccagcctgggtgacaaagtgagactccgtctcaaaaaaaaaaaatactttttagtatctgatattaggaaaatactttcttttcccctaaggaactagtatattctactttttcaataataagagccatgtaaactatcatctctccctttctctgtctctctctctctctgtaagagtggccaagaacctcaaaataactgtaaactcagtgagagccactgtattgaccctttcagttccatcatgtttatatgacttctcttagatcctgattttcagcttggggattctattgcagtttttctcaaagtgtggcctgggaacacctgtatcagaatcattgtaggtgtctgttaaaaatgctgattttcagacccctcacagacttgttaatcagaaactccagaagtgagattcagaaatttgcattctacacaaacatcccaggtatcctaatgctcagttaagtttgagaatctatggcctattttttttttttttttttttgagatggaattttgctcttgttacccaggctggagtgcaatggcacgatcttggcccactgcaacctctgcctcccgggttcaagcaattctcctgtctcagcctcctgagtagctgggactacaggcgctggccaccgtgcctggccaatttttgtatttttagtagagacagggtttcaccatgttggccaggctagtcttgaactcctgaccgcaggtgatccaccggcctccgcctcccaaaagtgctgggattacaggcgtgagccaccgtgtccgacctcatttttatatgttatttgttgtaaaacactcaacattcttcttggaagaaaaagaaatttacataagtggtataatataagaaaatatgctgcataacataatgatgatggccttcaggtaatgttaacagcattacttaaaataattattaatgtattatcttaatttttttttttttttttttttttgagacagagtttcactgttgttgcccaggctggagtgcaatggctcgatctcagctcactgcaacctctgcctcccgggttcaagggattctcctgcctcagcctcctgagtagctgggattacaggtgcccaccaccatgcccagctagttttttgtatttttagtagagatggggtttcacaagaccaggctggtcttcagctcctgacctcaggtgatctacctgcctcggcctcccaaagtgctgggattacaggcatgagccaccacgcctggccattatcttaatttttacttgacctttgtacaatggtatgaaaatagttctctatcaagatttattctgttcacaacattctacaagtgactatttttcttcagaaattatgacaatattaagtgggtgtattaagtaaaacaagaaatcggtgcctaagagttagaaataaactaacatatacgtacaataagatatactgaggaccaccaagccccaggagctgcactttgtcagagaacactgtaacaagcaagactcagttccagccctcagattgcttatggtctgatgggaaacgtagacaggtaaacgggtgaaacctcttgcttgtgtccacagcaactggcagggtctgcaggaaacaggccattgccagaaagaaaatcatcttactattatctacacagagtccagaacaggatgcaaaaccaactctttactgcccccagtggaaaaaatcctcttcagtccatacggcaacaaccagagggccctcctagaatcaccctgctcctggcttcttcagtttcttcctctccccaccgtgggcttagtcctagcttcttgcaaggggtaggttccgatttctccttaaagactgttgcagagacagaattccagtctctctgattcttcccaggggcatatctaaaatatcagcaaactgttctctccccagaatcagcggactcgcattgaatctccgttttagcaaagcccaggctccacacctcccctgggaggcacagaaacacaggacagtccctcctaccccgccatgcaggcaattgctgcactgctggcatccccagcttgggacccagcacagaagccagacatagccccagggagccagtggccaggaggagtgttcagggcacagggaccagacgaataaaagctggagacaaaagagaatgctaggccaggcatggtggctcacgcctgtaatcccagcattttgggaggccgaggccagcagatcacctgaggtcaggagttcaagaccagcctagccaaaatggcaaaacccatctctactaaaaatagaaaaattagctgggcgtggtggtgggcacctgtagtcccagctactcgggaggctgagacaggagaatcgcttgaacctgggaggtggaggttgcagtgagctgagatggtgccactgcactccagcctgggcggcagagtgagactccatttcaaaaaaaaaaaaaaaagagagagaacactggtattgagggaatttcaagccattctaaatgcccggagaagtaattttaaattctactcatatttcaaggtttcatttaaatcacaccttatctatgaagtgctctgggattaggctactctcgtttatctccttcctttctaagcatctacgatatctatcattatgtggcacaaccttatgtttcattctgtagggacttctgttgttcacttgcttgatgtgagcaaactggtttccttaactaaaccataaactaccggagggcaggatcattgtttagagttttgctttatgatgacagttttattgagctataattcatataccacacaattcacccatttaaaatgtacaagtcagtgggattttctttagcatgcttataagagtggggcaaccaccctcacaattaattttaggacgttttcatcatcccccaaagaaactctcctgcagtagcagtcactcctcattttccacacccaggctgtgggttggattgtgtcccctccaaaaagattatgttcaagccctcacctccagaacctgtgaatgtgacccagtttggaagtgaggtctttgcagatgtaatcaagtaaagatgaggtcatactggattagggttggtcctgaatccaacatgactggcatccttataagactgcaatttggatgcagggacagagacacacaggggagaagaccgtgtgaagatggagacagagattgcggtgaagcagctacaaactaaggaatgccaaggatttgggggcaaaccccagaagcaagacaaggcaagaaagtgttcttccctgagtcctccagagggaccgtggccctgccaacgctgacttcagacctccagcctccagaatggcgagaatacgttccggttgtcctaagccacccagttttattcagcagccctaggaatctaaggcacaccccaacgatgctccccacctccaccccctagtaaaccactaaactactttctgcctctggagattaatccgttctagacattctgtataaaaggaattacataatatgtggccttttgttaccggtttctttgacttagtataatatttttaaggttcacctatgttgtatcagtacctcattatttttgttgctgaataatattccattgtatggctatatcatattttgtttatccatttatcagttgatagacacttggcttgtttctatttttttagctattatgagtattgctgttatgcagattcagacaggttttcatttctcttaggtgtatacctggagtgagattgctgagtcatgtggtaactctatgtttaaccttttgaggaaatgttacactgtctacctaagtgcctgcaccatttcatattcccatctgcagtgtatgagggtaccaatttatccgcacccttgccaacacttattatctatgtttaaattgcagccatcgtagtggatgtgaaatggtatctctttgtgattttgatgtcaatgtcccggatgggcagtgatgatgaacatattttcatgtgcttgtcagccaccttttttggagaaatgtctattcagatcctttgcccatttttaaattgagttattggtctttttgtggtgtagttatagaaggtctctgtttattctgaataactggattgtctttttattcttgtattatttatatactttatagttttaaaatattcctcagtttgcctcatgatcctgaacccatgaggagggttatccttgtgctcttagacatttctggtgttctaagaaatcattggtttttatttgatagttaatgaatggcctggaataacatatttcagagctttcaggtcaactttggggtaaagaaaggaacctaatatttactgactgcccaccatctgccagatgttgttggcatatgtgtgatcctcaccccaacctaggaaggttctgtgttatcatctccaataaacaggtaagcacaaagaaattaaataacaacagttttttaaacaccctgctcctttgtcccttcatgatgtggtaaaacaaagacatatcaaaaccagaggacttgcttgtcaagtttctaatgcctggaaaatgtcaccttggtacttcaagtcttattcaaggaactattaaacagtttatatggtttttcagctcataaattaataaaatcccttcaaatatttcccttaagtgaagtataggaatataagtattgttccaagtcttctgttaaaaattgaagcacagaaatgggactatgactaaattaactgaatagtaaaaaagagcttgtgattcaggaattcagggagagagttcgtgagctctgcagaggtaacctgtatgtgcatgctccaaaatccaccggcactttcccggcagtccaaagtgcaaatggtttctgcagctcatgattctggctccaggccagcgccatgctcacttgaattgcagccaaacaccctcggactcattgcctgaacatgtgactcaaatgctcgcgttcccgctgctcagtgtactctcctggagaccccctgacatcaaattcccaaggatctcatttcattttttatagacaagtgtcttcacccttccaactctaaagatagatgtgaggtgaagatatattcttcagggtttgaaagctctatataaagtcccccaaacatttaaaatctggagattcatctctggaaaacagtgcatctgatcatcttgatttacagcctgtactggaagtttttcttttagaacaaaagctatttgcaaaccattcctgtttgtaaataaattattttcctaaatatcaaaggaagacatcagaaagtacaaaaagaaataatagatggaataatttcttgaaatttacccaaatagataatgagcaagacaactgatagctctcagaataaatattctctgagagtaagactaatacgatcatgccaatagtttagtttgacttattttcatagcgctgcccaaacagatatggagaaaggaattattttgccatgagataagacttaatcatctctgggaaagggaatccacaggaacatttttgcttatgcaagaaagatcctgtttatactgcatgattctttgcagtttttctctcccatcccctgtggctgtgtagttctatcctatttgtggccctgcttctagattgaggccccataaagcaggctgcacaatgcctgcagcacattatttcttgaagaaatcccagggaaaatagacagtgaaacttagcttccctggtcttagaaaagggcaaagaaatttttgtttcccccaaaggccagttgaaaaatgtcgtgttgccccagaagtccagccctggcccttccttgctgcaaagagtcaattggtgcctccaggtccttgcttttccttgacgacagactggtgtagtttgagacatccctggcccttatctcagcccagccctttgaagcacttgacagccgctgctgctgccacttgcttatcccaagggaggaagtagcttctgaaggctttgaggtccagttcagtctggatgtttgaaagggtgaaaggtaattttaatatgacttctaatttatgtgatgcttacatttttttgaattctgtgcttcccaggggacacagtaattgaaagtgtttttcatcccatagcaggaagggatgagggttgatggatcgattttcctctgattgttaaccctccacctctccttccccctcagcttcactgtgtgttatgtctgtttgtctatcatgtctgaaaacctagtttgaattacaaaataggttgagaggagcagtgggtgaaaggatggagttttctcttcgataatttattcagcgggtgctaaagatttggggatcttcttgtcttgattgaatggtgtaatggttaatactgagtgtcaacttgactggattgaaagatacaaagtattgatcctgggtgtgtctgtgagggtgttgccaaaggagattaacatttgaatcagtgggctgggaaacgcagacccacccctaatctgcgtgggcacaatctaatcagctgccagcacggctggaatatgaacaggcagaaaaatgtggaaaagagagactggcctaggctcccagcctacatctttctcccatgcgggatgcttcctgccctcaaacatcagacaccaagttcttcagttttgggactcggactggctctccttgctcctcagcctgtaaatggcctattgtgggaccttgtgatcatgtgaggtaatacttaataaactccccttcatatatattccattagttccgtccctctagagaaccctgacaaatacagattttggtaccaggagtggctctagagggacagaatattaaggatggagttatttcattggttttggggtttctggagtttgcttcttaatatgattagacccaaaaatggtaaagactttacttctaatggtatggagaatgctgatagtccttgtcgtgaactgtttagagagttatgcaaaataaatgcatttgacactcctgattcatcactcgtgagaggcaaagagcttagtgactctatacgtaatacctttgaccatatgtggagaaccagggagcataatgaagctgattggttacttctaagttcaatggacaaagtgatgaaagaaaatgatgaactcagggattctgtctcccggctttagaagcagacactgagcctcaaatctgctaagattatcctaatgagagtcttatcgcctgtagaaaaagagctgaaattatggaaaaacagacacaagctcttatcatgttgagtggctgacctgcaacaaaaggtgcatccacagccttgccaggtgtctactgttaaaatgagggcattgattggaaaagaatgggaccctgcaacatggaatagggacatgtgggaggaccctgatgaagctgggggcactgagtttgtaaactctgatgaaccttttttgccagagggaacatctttcccatccccagaaggggcaatatccctccctgacccatgctgccatcagcctttccatctctgtctgaggagataaaccctgcactgcctgaggcagcagtgatggcctcccctgaggcagctgccaggcaagataatgttgattctccccaggagccacccccaacacccctgtttgcttccagacctataactagactaaagtcccggcaggtccctggaggtgaagttgagaatgtaacccatgaggaggtgtgctacactcaaaaagaactgcttgcattttctaatttatataaacagaaatctgaagaacaggcatgggaatgaatactaaggatgagggctattatggtgggaaaggccaaatggaagccattagagcttcccctacctagaaaaatagtaaatcaaaaacaatatcacatccctggagggattacagagattagtgccaccattaaggacttgaaagatgcaggggtcattgctgaggcttgagtaggtaaacaaagcagcctggaagctcgaattgggtggagcccaccgcagttcaaggaggcctgcctgcctccatagactccacctctgggggcagggcatagccaccaacaaaaggcagcagaaacctctgcagacttaaatgtccctgtctgacagctttgaagagagcagtggttctcccagcacagtttgagatctgagaatggacagacggcctcctcaaacgggtccctgacccccgagtagcctaactgggaagcacccccagtaggggcagactgacacctcacacggccgggtacccctctgagacaaagcttccagaggaacgatcaggcagcaacatttgctgttcagcaatattcgctgttctgcagcctccgctactgatacccaggcaaacagggtttggagtagacttccagcaaattccaacagacctgcagctgagggtcctgactgttagaaggaaaactaacaaacagaaaggacatcagcaccaaaaccccatctgtacatcactatcatcgaagaccaaaggtagataaaaccacaaaggaggagaaaaaaacagagcagaaaagctgaaaattctaaaaatcagagcgcctctccccctccaaaggaacgcagctcctcaccagcagtggaaccaagctggatggagaatgactttgaagagttgagagaagaaggcttcagacggtcaaacttctccgagctaaagaaggaagtttgaacccattgcaaagaagctaaaaagcttgaaaaaagattagacgaatggctaactagaataaccagtgtagagaagtccttaaatgacctgatggagctgaaaaccatggcatgagaactacgggatgaatgcacaagcttcagtagccgattcaatcaactggaagaaagggtatcagtgattgaagatcaaatgaatgaaatgaaatgaagtgagaagagaagtttagagaaaaaaagagtaaaaagaaatgaataaagcctccaagaaatatgggactatgtgaaaagaccaaatctacatctgattggtgtacctgaaagtgatggggagaatggaaccaagttggaaaacactctgcaggatattatccaggagaacttccctgacctagcaaggcaggccaacattaaattcaggaaatacagagaatgccacaaagatactcctcgagaagagcaactccaagacacataattgtcagattcaccaaagttgaaatggaggaaaaaatattaagggcagccagagagaaaggtcaggttacccacaaagggaagcccatcagactaacagctgatctctccgcagaaactctacaagcagaagagagtgggggccagtattcaacattcttaaagaaaagaattttcaacccagaatttcatatccagccaaactaagcttcataagtgaaggagaaataaaatcctttacagacaagcaaatgctgacagattttgtcaccaccaggcctgccctaaaagagctcctgaaggaagcactaaacatggaaaggaacaaccagtaccagccactgcaaaaacatgccaaattgtaaagaccattgaggctaggaagaaactgcatcaactaatgagcaaaatcaccagctaacatcatattgacaggatgaaattcacacataacaatattaaccttaaatataaatgggctaaatgctccaattaaaagactcagactggcaaattggataaagagtcaagacccatcagtgtgctgtattcaggagacacatctcacatgcaaagacacacataggctcaaaataaagggatggaggaagatctaccaagcaaatggaaaacaaaaaaaaagcaggggttgcaatcccagtctctgataaaacagactttaaccaacaaagatcaaaagagacaaagaaggccattacataatggtaaagggatcaattcaacaagaagagctaactatcctaaatatatatgcacccaatacaggagcacccagattcataaagcaagtccttagagacctacaaagagatgtagactcccacacaataataatgggagactttaacaccccactgtcaacattagacagaccaacgagacagaaagttaaaaaggatatccaggaattgaactcagctctgcaccaagcggacctaatagacatctacagaactctccaccccaaatcaacagaatatacattcttctcagcactgcatcgcacttattccaaaattgaccacatagttggaagtaaggcactcctcagcaatgtaaaagaacagaaattataacaaactgtctctcagaccatagtgcaatcaaattagaactcaggattaagaaacccactcaaaaccgctcaactacatggaaactgaacaacctgctcctgaatgactattgggtacataatgaaatgaaggcagaaataaagatgttctttgaaaccaatgagaacaaagacacaacataccagaatctctgggacacatttaaagcagtgcatagagggaaatttatagcactaaatgcccacaagagaaagcaggaaagatcaaaattgacaccctaacatcacaatggaaagaactagaggagcaagagcaaacacattcaaaactggcagaaggcaagaaataactaagatcagagcagaactgaaggagatagagacacaaaaacccttcaaaaaagcaatgaatccaggagctggttttttgaaaacattaacaaaatgcatagactgctagcaagactaataaagaagaaaagagagaagaatcaaatagatgcaataaaaaatgataaaggggatatcaccaccaatcccacagaaatacaaactaccatcagagaacacgataaacacctctacgcaaataaactagaaaatctagaagaaatggataaattcctggacacatacaccctcccaagactaaaccaggaagaagttgaatccctgaatagaccaataactggctctgaaattgaggcaataattagtagcctaccaaccaaaagaagtccaggaccagatggattcacagccgaattctaccaggggtacaaagaagagctggtaccattccttctgaaactattcctaacaatagaaaaaaggagaaccctccctaactcattttatgaggccagcatcattgtgataccaaaacctggcagagacaaaacaaaaaaaaagaaaatttcaggccaatatccctgatgaacatcgatgcaaaaatcctcaataaaatactggcagactgaatccagcagcacatcaaaaagcttatccacaacgatcaagtcggcttcatacatgggatgcaaggctgcttcaacatatgcaaatcaacaaacgtaatccagcatataaacagaaccaaagacaaaaccacatgattatctcaatagatgcagaaaaggcctttgacaaaattcaacagcccttcatgctaaaaactctcaataaattatgtattgatgggacatatctcaaaataattagagctatttatgacaaacccacagccaatatcagactgaatgggcaaaaactggaagcattccctttgaaaactggcgcaagacagggatgccctctctcaccactcctattcaacatagtgttggaagttctggccagggcaatcaggcaggagaaagaaataaagggtattcaattaggaaaagaggaagtcaagttgtccctgtttgcagatgacatgattgtatatttagaaaaccctattgtctcagcccaaaatctccttaagctgatagcaacttcagcaaagtctcaggatacaaaatcaatgtgcaaaaatcgcaagcgttcttatacaccaataacagaaaaacagccaaatcgtgagtgagctaccattcacaattgcttcaaagagaataaaatacctaggaatccaacttacaagggatgtgaacgaccgcttcaaggagaactacaaaccactgctcaatgaaataaaagaggatacaaacaaatggaagaacattccatgctcatgataggaagaatcaatattgtgaaaatggccctactgcccaaggtaatttatagatttaatgccatccccatcaagctaccaatgactttcttcacagaattggaaaaaactactttaaagttcatatggaaccaaaaaagagcctgcattgcccagacaatcctaagccaaaagaacaaagctggaggcatcatgctacctgacttcaaactatactacaaggctacagtaaccaaaacagcatggtactggtaccaaaacagagatatagaccaatgcaacagaacagagccctcataaataataccacatatctacaaccatctgatctttgacaaacctgacaaaaacaagaaatggggaaaggattccctatttaataaatggtgctgggaaaactggctagccatatgtagaaagctgaaactggatccattccttacaccttatacaaaaattaattcaagatggactaaagacttaaatgttagacctaaaaccataaaaaccctagaagaaaacctaggcaataccatttaggacataggcatgggcaaggacttcatgtctaaaacaccaaaagcaatggcaacaaaagccaaaattgacgaatgggatctaactaaactaaagagcttctgcatagcaaaggaaactaccatcagagtgaacaggcaacctagagaatgggagaaaatttttgcaatctactcatctgacaaagggctaatatacagaatctacaaagaacacaaacaaatttacaagaaaaaaacaaacaaccccatcaacaagtggatgaaggatatgaacagacacctcccaaaagaagacatttatgcagccaacagacacatgaaaaaatgctcatcatcactggccatcagagaaatgcaaatcaaaaccacagtgagatactatctcacaccagttagaatggaaatcattacattaaagtgaggaaacaacaggtgctggagaggatgtggagaaataggaatgcttttacactgttggtgggactttaaactagttcaaccattgtggaagtcagtgtggcgattcctcaaggatctagaactagaaataccatttgacccagccattcattactgggtatatacccaaaggattataaatcatgctgctataaagacacatgcacacgtatgtttattgaagcactattcacaatagcgaagacttggaaccaacccaaatgtccatcaatgatagactggattaagaaaatgtggcacatatacactatggaatactatgcagccataaaaaaggatgagttcatgtcctttgtaaggacatggatgaagctggaaaccatcattctcagcaaactatcgcagggacaaaaaaacaaacactgcatgttctcactcataggtgagaattgaacaatgagaacacatggacacaggaaggggaacatcgcacactggggcctgtcgttgggtggggggaggggggagggatagcattaggagatataactaatgtaaatgatgagttagtgggtgcagcacaccaacatgacacatgtatacatatgtaacaaacctgcacattgtgcacatgtaccccagaacttaaagtataataataaaaaagaaagaaagaaagaaagatgcagaggtggtgattcccaccacatccccatttgggtctcccatttggcctgtgcagaagacagatggatcttggggaatgactataagtttaaccaagtggtaactccaaatgcaattgctgtaccagatgtggtttcatcgcttgagcaaattaacacatcttctggtacctggtatgcagccattgacttggcaaatgcctttttctccattcttgtccaaagccccaccagaagcaacttaccttcatctggcaaggccagcaatatacctttactgtcctacctcaggggtatagcaactctctggctttgtgtcataatcttattcagagataccttgatcacttttctctttcacaagatacaacactggtccattacattgatgacattatgttgattggatccagtgagcaagaagtagcaaacacactggacttattggtgagacatttgcatgccagaggatgggaaataaatccaactaagtttcagggaccttctacctcagttaaatgtctagaggtccagtggtatggggcctgttgagatagtccttataaggtgaaggataagttgctgtgttttggccccaactacaagcaagaaagaggcacaatgcctagcgggcctatttggattttggaggcaacatattcctcatttgggtgtgttactctggcccatttatcaagtgacccgaacggctgccagttttgagtggggtccaggacagaaggaggctctgcaacaggtccaggctgctgggcatgctgctctgccctttgggccatatgacccagcagattcaatggtgcttgaggtgtcagtggtagatagggatgctgtttggagcctttggcagcccccataggttgaatcacagcagaggcctctaggattttggagcaaggacctgccatcttctgcagataactactcttcttttaagagacagctcttggcttgttactgggttttggtggaaactgaacattcaactatgggtcctcaagtcaccatgcatcctgacctgcctatcatgacctgggtgctttctgacccatctagccataaagtgggtcatgcacagcagcatttcatcatcaaatggaagtggcatatatgtgatcgggctcgagcaggtcctgaagggacaagtaagttacatgagaagatggctccaatgcccgtggtctccattgctgccaccctgccttctctccccgagcctgcactgatggctttgtagggagttctctgtgatcacttgacagaggaagaggagaccagggcctggttcacagatggttctgcacgatacgctggcactacctgaaagtggacagctgcagcactacagaccctttctgggacacccctgaaggacagaggtgaagggaaatcttcccagtgggcagaacatcgagcagtgcacctggttgtgcactttgaatagaaggagaaatggccagatgtgtggttgtatacagattcatcggctgtagccaatggtttggctggatggtcagggacttggaagaagcatgactggaaaattagtgacaaagaaatttggggaagaagtatgtggatgggtctctcggagtggtcgaaaactgtgaagatatttgaatcccatgtgaatgctcaccaacaggtgacctcagcagaggaggagtttaataatcaagtggataggatgacccgtcctgtagacaccactcagcctctttccccagccacccttgtcatcgcccaatgggcccaagaacaaagtgcccatggtgacagggatggaggtgacacatggtcttagcaacatggacttccactcaccaaggatgatctggctatggccacggctgagtgcccaatttgccagcagcagagaccaacactgagcccttgatatggcaccattcctcggggtgatcacccagctacctgatgacaggttgattatattggaccttttccatcatggaagagcagaggtttgtcctcaatggaatggacacttactccagatatgggtttgcctatcctacccgcaatgcttctgtcaagactaccagccataaactcacagaatgccttatccaccgtcagcgtattccacacagcattgcctctgaccaaggcactaactttattactaaagaagtgcggcagtgggctcacactcatggaattcactggtcttaccatgttccccttcatcctgaagcagctggattgatagaatggtggaatggccttttgaagtcacaattacaacaccaactaggtgacaatactttgcagggtggaggcaaagttctccagaaggctgtgtatgttctgaatcagtatccaatatgtgatactgtttctcccatagccaggattcatgggtctaggaattaatgggtagaagtagaagtggcaccactcaccatcacccctagtgatccactagcaaaatttttgcttcctgttcctgcaacattatgtactgctggcctagaggtcttggttccagaggaaggaatgctgccaccaggagacaaaagaaggattccattaaactggaagttaagattgccacctggacactttgggctcctcctacctttaagtcaacaggccaatgggctcctcctacctttaagtcaacaggccaagaagggagttacagtgttagctggggtgattgaccctgactatcaagatgaaatcagcctactactccacaacggaggtaaggaagagtatggatggaactcaggagatccattagggtatctcttagtattaccatgacctgtgattaagattaatgggaaactacaacagctcaacccaggtaggactacaaatgacccagacccttcaggaatgaaggtttgggtcactccaccaggaaaaaaaaccacgacctgctgaggtgcttgctgaaggcaaagggaatacagaatgggtagtagaagaaggtagtcatcaataccagctatgaccacatgaccagctgcagaaatgaggactgtaattgtcatgagtatttcttccttcttttgttaaaaacatatttgtgcatgtgtacacatgtactaagaaaatatcttcattttatttcctttctcctttatcatgtgacataaatttattgacttcatgtcagcatttaagtattgttaactttatgtaatggtatttgggttggagattggtgcatttccaattgtacaaaggatagttgtattatgttaggtgtaattatgaccttattattgtctttatttgaagattatgtatgatctcaggagatgtgtatgggttcaagttgacaaggggcagacttgtgatggttaacactgtgtcaacttgattggattgaaggatgcaaagtatcaatcctgagtgtgtctgtgagggtgttgccaaggagattaatatttgagtcagtgggctgggaaacgaagactcaccattaatctgggtgggcacaatctaatcatctgtgggcacggctagaatatgaacaggcagaaaaatgtgaaaaggctagactggcctagcctcccagcctacatctttctcccatgctgcatgcttcctgccctcgaacatcagacaccaagttcttcagttttgggactgagactggctctcagcctgcagacggcctattgtgggaccttgtgatcatgtgagttaatacttaataaactcccctttatatgtatatatatattccattagttctgtccctctggagaaccctgactaatataaatggttacctttagttgggttaaatccagtgaattcctttggatgtgttcttcagttgacttaaaaaaagaaaaagaaaaaaaatttcagtgaattcttgaaagaattaaacaaactgggcatagaaaattgtatgttacataaaaatatgtacaaacattattttaaatataaatctgtattcctactttaccaaaaagctgattatactgatgacaataatgcaattttgttggtttgggaaaatgcaaaatcaccagactaattgcaacagcacttctgcaataatgctactgatttattgaatacctactatgtgccagtcactttattgaatatgatttctaataatcacagggcagatattattatctccactttactgatgagcaaactgaagttcagagaggtatcgatcatttgtccaaggtctgagtgctgtggaattgaaatcaaagtccaccagcatttatcagatcgagtaggtctgaagttcctaatgctgaatacaaaagggcacagttatctaggataaatataaaatgcatgagatgccagggcaacaggcaaaccaggacatacgatcacctacactatacagcatcatcttgagaatatgtgcactgctgccacagtctttgcaaacaatcaaatgtacaaggggttgagaaaataaagtacagttataaggagtattcaacagaagagtgaaatgtaacaagatagaattggagggttaatttcaggtaagtttttgaaagctctaagagccaggagaggagttcactctttatcctgtagtcaatgctacatagctacaaacattggtatggtgtttgacaagtgctttcatatacactattacacttgacaatgaaagtatgatagttggtacttccagagaggttatgtgactttcccaagactgctaaactggtaagcagtagagttccctgtttctacaaagtctaggcttttcctacttttccatattacttgctagtttctaaaacatccagtcccttgagattacaagttatcatcagaaaccacaacaaaaagcacattgtttcacatgggagaatagcacatggctgacccattattctgttagcatgggttacaatcattttcctagaagggcattaagtcctatacaatagacgttaggaacaagaggctgaggcaggcggatcacgaggtcaggagatcaagactgtcctggctaacacagtgaaacctcgtctctactaaaaatacaaaaaactagccgggcatggtggcgagcacctgcaatcccagctacttgggaggctgaggcaggagaatcccttgaacctgggaggcggagcttgcagtgagctgagatcacaccactgcactccagcctgggtgacagagcgagactctgtctcaaaaaaagaaaataaatactaaaaataaaaggaacgagaaaatggttatttgtaaccttttcttgatcatgaatgtcctaaataccttatagaaaaattaagaagaaaaaatatataaagaagaaaacaaaaatcctttataattttacaactgagagataattttaacactctggtgcattttcttccagtctttggcataccctaaagcttgaatgtcattgcacccatgccatctccacctgctgtgaccctatcttcggaatacttctcaaatccatcaattcctatgagctctaccctcatatatgtcacctcacctcgtgcctagattagcgcattttcccagcagccagtctcctgagctccagtctggcatacgctgtccacattcatttggcgtactgcagacagaggagtttttggcttgtttgttttttaagacagagtgttgctctcttgcccaggctggagtgcagtggtgtgatcatggcttattgaagcatcgacctgctgggtttaactgatcctcccacctctgcctcccaagtagctgggactacaggtgcatgccaccacgacaagctaattttttttttttttttttttttttagtttttttgtagggataagttctcaccctgttgcccagactggtctcaaactcctgagctcaagcgatcctcctgctttgacctcccaaagtgctaggattacaggcatgagccacccacccagcccagagtaattttcctaaaatgcaaactgtttaaatgccttgaatggcttccccttatccataggataaaactcagactatttgactatttgccatgtctttttttttttttttttttgagacagagtttcactctatcacccaggctggagtacaatggagcgatctcagctcactgcaacctccgcctcccgagttcaagtgattctcctgccttagcctcccgagtagctgggattacaggagcccaccaccacacctggctaatttttgtatttttagcagagacagggttttatcatgttggccagcctggtctccaactcctgacctaaggttatccgcccaccctggcctcccaaagtgctgggattacaagcacgagccacctcaaccagcttagccgtggctttcaaggcccttcaccccactgctcccacttccgctctctccactgggccctcacagtctgcctgccttcccacctccccacgtggctctacagaccttctgagccatgccctctgtctggaacctcccaatggcactctcgcagctggaacactcctccttaggctctctgcctaactgcttttcagttttcaaacctcagctcatattttaattttggggggatgatttatttgaccccctgcctctctctgcccaggattagaggcttctgccacaatctcaagttctccctctgttcctgtgataacacttatctcactgtattattatcttcttgtttcactgcctgtctccttacctagattgtaaactgtgaaggcagggtcttatctcttctattccccactctataccccgcatgtgtcacaggacctggcacagggcaggcactgaatattcttcactaaatgtgtgtgtatagggcaaacatgcatacaccaatatatagcatatgaagtgtttaataaatctgtataattttcccgcagattattttgcattttctttgtagaaattaatgttatctgtgtgttagatatgagttctaaatttcttttcaaagaattaatatgtcagtatgttcaattctttgccttctacttttaaacttaacttcttcgtaaagcaacctttttcgattacctactccatcctgactcattccgatcacctgctccaccctaactcattctaatcacctgctccaccctaactcgttcagattatctgctacctgctctgccctgactcccgccgaagcactcacccggtcattctctttaaattagccagtcagaattaatttagcctgtgcggtctaacactagccaatagggaaacgacacagcagcaggggccacgtgcgtcatagataagaacctcttcccctctcttgtccgagtgtgcgctcaccattgttccatctggaagggtgcacccttctatagaagtaacttgccttgctgagaattaaaaagaaaattttagactcgagtgctattccttttgcggcaccaaaactttacataacatgtgaataatgacagttttgcttcttcctttctagtccttatcccttctgtttttccttgtcttacggtgcagctaagatctccaatgcaatgtcaaatggatgtgctgatagtttgcatttttgtatctgatttttttttttttttgagacagcgttttgctctgccacccagactggagtgcagtggtacagtcatggctgatggcaacgtcaacctcctgggcttaggtgatccccccacctcagcctcgggggtagctgggactacaggcacacaccaccaagtgcctgtattgtattttttgtagagatggttgcccaggctggtcttgaactcctgggctgaagcaatctgctcgccttggctttccaaagtgctgggattacaggtgtgagccaccactcctggctgcatctgattttttaaagggaaaagtcacgattttgacattaactatcatgcatgatagagatttttgattgatactcttcatcattttaaggaaattctattctagtctcagtttaagaagcttctcttcataaattatgaatgaatgaatgaaaaattttatctgtgagttttctgtttcaccaagatggtttaccttctttaatctgttaatgcattgaattacattacattgcctagtgttaaaacatccttacagccttgcaattggtcttgatatattattcttttacaatattgttttgcagaatttgatgtactaacattttatttagcattatgaagtctatgtttattagtaaaattggcttataattttcttttcttttgctatttttgtctggttttgagatcaagaatatttatagtctcataaaatgaattggaaaactttctctttttttctattctctaaaacaatgtatatgtaataaagatgacctagtccttaaatatttgacagaactcatttataaagctatctaaacccactgcaggtttatacatatagatctattagctgaagcttgttaattgtttggttcaaatcacctgtgtctgtatgcctttgtgtatttgcaaagattcttaatttgtcttttacatgcaaatttatttttctacactatctgttctgctgtacagtgccttcaaagtattttggttatgttttacttttgtttcatcctttttatccaattccatttatatgtcaacctgcatctttatttatttttcatatcttctgtataattttgcaatgttagtattttcctgtaattgtttgagatcacaaaaaggttgctttcaaaggttgacttccatgtttttctactgtaaatcatcttccaaaatatgcatttgctctgcatcttcagggccatgctctttattcttttctgaactatcatggtccctgtattgttgtttcagttgattcatctttaagtaaggaaatccggaggaagcatgtgtatacaatctgttggaaaatatctggctatctactggatctgatgaccttgagtaacactgttgtacctgcatcttagtgcatgtttcacacaatgtcttaattagagaggcttttcccacaatgctcagcccctgccacagcccttaaagggccatgctgctttttcaatctttgaagtctttggacaactttaccgatgggaaatttcatataggtcctccctctgctgattggccatagcgtaatgaaaaaaaagatcatcaattaattggcttgtgacaccatagctgtgagataacaaataggtctcgcctcacataccaactcccagtgggtgtggtggctgcctggggaactttgttgagaatgattctgaggccctctctggctcagtgggaaagagtgctttcattaatgagttatatctgctaggggcatgggagcagggagtggcaggatgaatgccacctatctgctgcccctgttctaatggctgtccacaggtgtgacataagatataaaaattaatagtaagctgggcttaaagggcctggcctccttgaagcttttaagggactcaattccacaatacccagtgatatatgacagtggacttagcttatgaagtgcttgccccagacaccagtgatctgaaattgtccaaaactccagagaatggcagactaaacacaggcgaattgtgtaatcaagtggcaaactgcccgagcgatgatctttctaggtgtgaacacacctagcttcactgccttatcagagttgggcctgcataaacctttgccgttctttgttagatctggctgggatctttgcccccacactcccactctccccttacccaaaagaggcttagccctcctcattccttgttcatcattctgcacagggttggggggaagtgacacaggcctgtccattcttagttcagaaagtggtccccaaatggtatgtgacctcagttggaattttatatacaagcacttgaaggaaccactttctctagaatccagaattgggactgggatgatgaaagcctggaactctctgatgcctccaccataatgaagacatccatgtgtattgggagagaaggaagctgacagagaaaagcagaggcgagagagagaaagagagagagagaggcagaggctaagaaagagagaggggacacctgctgacatctctggagtttcttgaacttttgatatgtactccattcctggacttgatcatatgagtcagtacattcatttgaaattgaactattttgatttgggattgtgtctcttaagactgaaggagtcttaacaaatacaatggcaactgcttttgttaactgtcaatgttggttgagactggttggtttgcctctccattttagagatgtcaaaggaaaataaatcttgggaccccaaaatcactaagccaaggggaaagtcaagctgggaactatgtcaggcaaacctgcctcccatgttatttttaaataagaccgctacaaaataaaaagctacatatctccttcacaatttggccacaaggaaattccttctggacaaaggacagacagaactcaaagtcatccctctgagtctcacctgagacaaatgcttatctgagtgcttcctctgccctattgtttaggtgaaaatgcagattcactgagccagactaaattgtgtattcagtgcaaagctgatcaaagactcaaaagaatgcaaccttttgtctcttatctccttatgaccacctcaagttgtcctgccttactagaccaaccctatgtctccctagaatgtgtaaaagcaagctgtaccctgaccaccgtgcgtatacgttgtcaggccctcctgaggctgtgtcacatgtgcgtccttaaccttggtaaagtaaactttcgaaattgattgagacctgtctccaataccttttggtttacagaggagattcatgattcatgaacagaggcctgtgttgctcccattgcctctgagcctctccagaggtcccaatacatcctccctcgccctcagccatgctgcctacagggaatggaagtcacagaatgaatgtgttaagaggagactcctgcaggtgggtggcagggtctgtggctgagaagagaattctactacagtgtggagtgcccttctggttagttcttcctccccaccctaaagtgggaaatattttcccacttctttatagccatcttttttcttcaattcaaaaggcaaagtgtacatacatagaaatttatttctcaattcaacccacaaagatgcagtttcccagagtttagcatatagctttcagtctataatgttgccaattggtcttctgggtctctccatgagtgatttaattaaaaagaaaggaaagatgaatagagtactgttggtttgcaacagtgacgatttggaaattcctgggcaggtacatttccacggcatggtaaggattctgggaagaacagcgctttggcactgcctgtgcggcccaaggcagctggaaggggtcctacagatcctggggaaaggcactaaaacaagaaaaggagtgggtggtgccagagacaaacttcaacagtttcctgactttgcctacagcccgccctgactggtttaggcttgttaacgaaaacattcttcctattcctttctcctgcctagttttgaatgatgacagtgctgtagatatgatgcctttatgacatttaaccacaaatggcaccaattagtcatctcataaagctcaacagcgccaggactatcctttatctcagctctctggggctgggagtgggagatcggagtagaatatgtgtctctagcctgaagaaaagttgtcaacaaatcagttcttcatctaatctgaggtgacaagtggggtgatgtattccagctaaagcattcttggctccagatgactttgtaaagataataaaatgtgttcatgttcacatgttcgtcaatgtctccagttctggcctcggcagcttttcagaggcaaaaacttccctcttttattccctgtcctaactgatgaaaaggtgaagtgttgtaatagatcaatctctttacaatctatctgctttttgaccgataatgctgacataattttagggaattgtaagagaggagatagccttaaattaggcatttacaggggacggagagagaggtaaagtggtacttacagcttcactgcaggagatttaagaacaatatctgtcgatcactgtgaagagtctgagatttaacctacattcaatttcacaagttaacctgccatagttccatggatgctggtagaaggtatgaggcccctggggttagagacagaagacaatttattactcccagtaatagcaatagtcaaagtatcagcatatttgcactggtaagacccacctcccacagggtgataggaagagggccagatgacactggaacaatcctatacatgcagtcagttacattacaagggcaaaatcttgagtttaggcaacctgaatctttcatcaggggccataatctcacctgccttttgctccgaaggaaaatattatgtctatcttccaagactgattgataaacaaacctccttgaaaagataatgcagaacaaagagcagttagcctttgcttatgagagtacaggagtgtgacaaacctgtgggaaaatttctcctaacaatgtgcaaccctcatttcaatactgttgcattagcttccagagatttgccataacaaatcatcccaaactgggtgggttaaaacaacacacatttcttcttgtgcagttctagaggtgaagcgtctgttggcatggccctgtttcccctcaagactctagaggagtagtcttccttgccctttccggtttctggtggcttctggtgttccttggcttgtggctgcatcactctggtctctgcctttgtctttgcatagccttcccctcttagctcctgtgtccccatctatgttctcttatacggactcatttcattggattgagtttaggaaatctgaatctttcataaggggccatataatccaacatgattctacccagataaccctacccagatacccagataatccaacatgatctcatctcgacatccttaatttaattaatctacaaagatccttttcctaaataaagtcacatcacaagttctgggggttaagaagtggatatatcttttgtatgggtgggtgtcattcaacccaaccatctcagcttctgataaattttcacatgaataccccactccatcagccatgttgattaaactgactgacagaggctgaaaccaaatctattcaaatagtcttctttcttcttctttttttttttttgagacggagtcttgctctgtcacccaggctggagtgcagtggcgtgatctcggctcactgcaacctctgcctcccaggttcaagcaattctcctgcccgagcctccccagtagctgggactacaggcacccaccaccatgcccagctaatttttgtatttttagcagagacagggtttcaccatgttggccaggtcttgaactcctaacctcaggtgatccactcaccttggcctcctaaagtgctgggattacagatgtgagccaccgtgcccggccccattcaaatagtcttatgcagaatttaattaacaagacttgaagcaacacaatgtggcctatttacattgtggaactcaatcatatcccccagagtcccagcctcaagttgaaaccaatcctataaaccatcatggtctaacttggaaatccaactagcttgctctttgtgttttgacttttccacttggcttgaggtattattccagatacagcaggatgtattagcacaaggaggaagtcttgggcaattcaatcattcctaacaatcctggccagtgaattgaagctatctgaatgcctcacagggctgaggtttgttttcccaaaatactcaaagctcttttatgactatacttaaggggtatgtgactatgtttccagaagagaggcaagttaatgtctggcttccacataagaattacagtttctgagatgcacatggtgccctagggaagagatgtttgcaattgccgatgccactcaaggaggacctgcattcgttggggaccatggttcatgatgctgcaaatatattctcctggttggctggttggcattagggttttccacaaagaacagttgaatctaatccttctttgtggaggaactacctgatagcagtgagtctaacctgacctttttgtccatgccaccagctggtggcatttgtttgttctgggcgatgattgagtgatacctacaagaaagggaggggcaaagacatctagaggtcttggcaagtgtgttgaatggggtggcaagaacaagtgtgttgaatggggtggcaagaactggggctatcccctgctgcttctgttaaacttcttggtaagattaacacgaatggaaatcaagtcctggtgataattatctggcagaggatggcaggcccagtagttagttaaaggcaaggcacttagtgcattggagtgttttctttcctggggaagatctcagggtatcttcccaccctcatactttctggggttggaggaactctctccccagctctcaccaccagagaatcattgtgttcattccagtggttactcatctcctacttcacccacatcttcgtctagataaattaggtgcaagagggataaaggcatattttaaaacttttattttaagctcaggggtacatgtgtaggattgtcatatgggtaaacttgtgtcatgggggcttgttgtacagattattttgtcacctaggttttttttttttttttttttttgaaactgagcctcactctcttgcccaggctggagtgcagtggcccatccttggctcattgcaacccccgcctctcaggctgaagcaattttaatgcctcagcctccctagtagctgggattacaggtgcatgtcactgcactcagttaatttttccctattttttggtaaagacggggtttcaccatgttggccaggttggtcttgaactcctggcctgaagtgatccatctgcctcggcctcccaaaatgctgggattacaggtgtgagccaccgcacctggcctcatcacccaggtattaagcctagtgctcattagttatttttcctgatcctctaccacctcccaccctctaccctccaataggccccattgtgtgtcgttcccctctatgtgtccatttgttctcatcatttagttcccacttacaaatgagaatacgtggtacttggttttctgttcctgcattagtttgctaaggacaatggcctccagctccatccatgcccctgcaaggacatgaccttgttcctttttatggctgcacagtattccatggcatatatgtaccatattttctttatccaatctgccatcaatggatatttaggttgattctatgtctttgctattgtgaatagcattgtaataaatatacatgtgcatgtatctttacagtagaatgatttatattcttttgggtatatacccagtaatgggattgctgggtcaaatggtatttctgtctttaggtctttgaggaatcaccacactgtattccacaaaagctgaactaatttatattcctaccaaccgtgtataagcattcctttttttctacaacctctccagcatctgttattttttgacttttgaataatcaccattctgactggtgtgagatggtatctcattgcggttttgatttgcatttctctaatgatcagtgatgacgagctttttttcatatgtttgtgggccacatatatgccttcttttgaaaagtgtctgttcatgtcctttgtccactttttaatgaggttttttttttttcttgtaaatttgtttaagtttcttatagatgctggatattagaactctgttggatggatagtttgcaaaaattttctcccattctatagggtgtctgctcactcagttgatagtttccttcgtagtgcaaaagttctttagtttaattagatcccatttgtcaatttttgcttagggcatttttataaaacttacagagatgcgttatatcttccattttggcccatgtgtgccagcatagggagactctgagcaatgtattcaaccagtggtcattgtcctggtgacccgggacatgtcaatccaacaggagaatccagacttcttagggtcccatttgagacagatggccactcagatagtacaagcctggccagctgggggttactcctaggagtaagaaagacacaccatacacaggaagtgctagagaagaatcccaaatttccagaaaaggtctcctcccattttgtcaagttattacctaggaagcagctgagagaagatgatcactttctgggacagcctcactcagtgaccaaactgttttagacacatgtgggaatctgaaggaagtcagggaggttgagtcagaaatctttttgagttcagttttgaggaggccattgcaatggccagaggcctgtggatgatgggagcatggaaggcctactaaataccttgactattagcacttggttgaatagtttttgcaatcaaaggtgtactgttgtcagactgtaaatcatccagaaagccaaaagcttatcacagagaagtttgaagggccactgtggtgtgagtagttggctgtacacactgcaacagcaacgttgtaacctaaaagagttgtcaacaggctgggcactgtggctcacacctataattccagcttcttggaaggctgaggtgggaaaccagcctgggcaacataaccagaccccattgctactaaaaaaatttaaaaattagctgggcatggtggtgcaagcctgtagttccagctatttatgagactgaggcaggaagatctcttgagaccaggaatttgaggctgcagagagccaggatcacaccactgtactccatcctgggcgacagagcaagaccctgtctctaaaaaacaacaacaaaaaaaattatatatataaaaaaagtatcaataatggtaaggcacccccaataggtaccagaaggggccaaaggttcaatttattcaatctgccaggagtttacagagacaacaccctgtgaaatgtggcctctcttgccacaagacaaatgggtccatttgtgacaggctccacagtctggcatgcagcagtagcctctccattggaaacaaagagtcctttactgtgtgccaagtctataacggtggatgttgccacatcttatacaatgatgatggatcgaggtggcagtggtggcagggtggatggtacaggctcaagtttggtccccgttggtcccacaagagaatgggcctttaatgtgggtgtttatgtgagtgatccaggcggttccagcagcagccacaatttgttctcacaattcaaagttcacagttcattggtccaaagatagttgtctttaatgtatagttttcaaagtggcatctaagccaccaacgatcaccagagagtcagtaaaatcataactagcttcatcaaaaggagtactggccagagtgatgagaatgctcctgttttctgcccgcacaggagaacgaccacctctatttttggttctgcatagctggtgctaaagctgaacagacacaatagtccagtgacactgtcaggtaccagcttagccaaatcaccagcgaagccggcccaggcactgaggggaacactgtgagggcaggaccacactgagccagcagctttgctgcaggcggtagcatggggatggaatttcccccaaaggaacagctgccactttttcacctaaaaccaagatactgtgggagccaggccagctgtgttcttgaacctactatttccatttgacaaatgaggtggttggggccttcccactgtgttagtcatggagtcaaagttgacccaccacaaagtgagaatacaggatgaagactcacaggcttctgagagtcaggccctcctttttgacaagagcccactagcgagctcagagctgctttttaaagagggtggacctggtcacaatgtcatggaagcaacaagtccaaaattccaagaggtggctctggatgaagcctgactccttttgccagagtctccagttggcaaagtcatcagttgcagagacatagagctgaggtttcattaggattgctgagccctgaagctggagagtgtgtctcagcttgctggacagcttctaatgcagtctgtttggaccctgctcatatcatgctgatgtgatatgagaaaagaaacaatgggatacccagtgaggtgcacactgtctcccatatccaaagagtacattaaggttctgggcatccttttgggtgatgggggtggggtgctgaagagatagcaatttttccctgactaccagtgtggctgtaaatagtcccaggaaactttgcctggtgagctagttcctggattttgtcaggttttatcagcttcacctgctggcagcttcacctgctggcatgctaataccattctcaaggtcactgagacgggcacttatggcttgccaaccaacaggacgtcatctacataaccaaagctatggacatcagagggtagaggcccttgcactaaattctgacccctcctctccactagtagcaagtggcagagaaatttaggtgctcatggaagactactgcaaatgtatactggaggctttgaaatgtgaatgggaactgtttatgatgcttaggtgccagtggtatggcaaagaagccattggtaagcatgccaagtgccattggtctgcgtaatggattcaattacagttacaatgtctggaacagctgggatatggaatcagcaactgaattcagtgggcaataatctactgcaagcctctgcctcttgttagccttttttcctggccatacaggcctgttgtatacaatccttactgcctttaaattcttaatcaagattattctcccccttgggagtctatattgtttctgttggaacaccccaaagggtgcagggaggggtctgcagagcaatgtatgtgtttcactaacttgtctctaaatgtgactcttctgaatcaggagaaccccctctagacagttacaatacaaggatgtaaaacattaataataattatgcattcagcagtggagtccacaacagcacacataaattggctcaaagggctctggcacaaggccactgtagctttccttctccactgcaaatcttgcccaaattccattggttaagttgggaattctctctttccacaggaccagagaggacagtgacttgggacctgtatctaataggtatctaatagatccataaaattggaagtctctcctttcccctcaaatctccagcacacttggacagatgagtatgacctttgaggcctgatgtggaccagggagaccttagcttcacctctaattgtttttctcattaaagtggttaagctgaagtagaggaggaggaaagcaatgagtcatgaaggagagagtggctctgcccattaaaaaaagctttgcatttacttttgtagagcatggctcattactccagcccaatgaacttgcattgcctttggcattcacagggttccacattggatggcaatgtccttgtggctgatatcatttatttcaaaaggcagaagaaccttctgcccacccacaacaaatcttggtactagtagttacaatggggtggacctgaggctgctctcagattggcaaggaagccctccatctggagggtagttagcaacaaccaaggtagttggggagttgtctttgaatttacttcctggtgttcagcctgcaaccagcttcccgatttctcctcataaacaggcaatgaagtggaagaccattgattgtcctgttgaccacaaaatggagtcaacatgcctctgccaactcccatgggctccattaggtcccattatctcacttacaagacccttgctttcctgttccagcagccacgtctccgtcagcctcccatcctcatctccagaattgtcaagaactgtgacgggtctgagattttagcgtactcacaagttaacaagttagcctggtacagtttcatagatgctaagggaccatttattacagcactagaagtagccttagtatcagcattttttcacaggttccctggtccccaattcctacagggtgacacaaagaggtccagatgacatcttgggttgtgttctaggagaggaaccctgagcttagggaacctacattttaggtggacaacaagcatacccgccctttgctctaaacagagacattctatctcctaaggcggttcactaagcaaacctccgtgaagagagagtccagatcaaagggtggtcaatgtctgcctcacaagatgtgcagacacactggagacccacagagaattgcctcccaaaaatgcttattttcattttattctttcaggtgttcacagttattttgaaatatatctctgtggcctaaaatattaaagacaatgcaacaaaatttgtactatcaaaatcattgggagagaatattaaatcttcacctgcagaatgactctaagatgggtaatgatgatgtacctaagaaatagctgagcaatatcttttatgggcttttaaaaaaggaaaccttttattttgaggtaactgttcattcacatgtaattgttagaaataaaacaggagatcccatataccctttaaccagttttccccaatggtaacatcttgcaaaactatagtacaatgtcacaaccaagatattgacatggataaagccaagatatagaacattccatcaccaccaggatcctggatgttgccttttcatagcagcaatatcttaacccatcttcctggttgtaaggtaaatcagtgccttagctaattagactgccacagatcaaagagataggattgtttacaccaataccagaaaaacattttacaaattatttttgtaaatatatgtagaatatatttcacatatttttgtaaatataagtaaaatatatttcacatattatttttgtaaatataagtaatatgtgttttatatattagaacatacagtaacaaagtagattaaaaaaaaacctccaccactatttaccaatttggtgtattttctttcaatctttttttatttgctgagagagagagaaatgggaggggtgagaactagtatttattacctacatatttatgtatctatcagatatatttttgttacattctggaaatcaataacatcagtgaaaaggagagagaattcttaccccctgttcctttaacctttaccgaagaaaggcaatgggtggggcagcacgttttatgggcagtttgtcagatctccaagactctaaggaattacagtgaccccacacagcaggcacagggactgtccagccacaggtggatggccagggatatccgcaggggctgaaagagaagcactcccaccagcttctgggtttggtcagcaactggtgagagactggacagctgaagaatgtgcccccagtggaacattttcaataaccattaggcttccaataaaaagaagttagaagcaacagtgtgaaagatgtgactgtttcctcagaggtcaaagcatgagtcactgtgaattaggcagtcaagggatggcccttttttgtgcactcacccccctgtcatcaaccagagtcattgttcttctgaataacccccccgtttcaatgccagggggttcacatctggtggtgacaggagagttttgccaacaggattccaaatgtcagcaggctgactggtcaatgcttactcaggcaagccttcccagtgaagccataattacctcccgctctcagaataggattaacaaatgcagttatttgtgtatgatccttttacatacaacctcatgcattttactcatgccagttaatatttcccattagaaaaatcctcttatatgaatgccatgataaataaattattggcattttaaaaaaaccttgttaaccagaaatggccgcaagggtgaaagtgtttataccttcatacaataatgcatttctctttttattttaagactgtttcctttcattcagtttatgagtaaggctgggaatcaattaagttttaagtgcaaagacaagggatatgattcctaaaaataaaagaagataatttaggtgtactttagaggtaattatagcaggattttgttcaaaagtttcccaatataactatgtgacttgtgaaaacctatctcaacactagtttcatcacctataaactggaggtaattcacgccaacctcacagagatgttttgattcagtaatgagtcttgtcttttgtggcagttctagaagctccaaggacaggtgctgccaactgtcccaatttagcctgtggcagtcctgcaagtgaaaatctcaagttcacccactggtcctggtccttatcaggaaaagggggctaaactgatgtttcaaactaaatatgattaaccagctggcgattatgagcaaggcaaacactctccaagcctcccttaatctataaaatgaatgtggagagggaagtagtagctagatgatatcagagacacctgacagcatattagactcatttagggatatttaaaccgctagtgtcctgaccacacctgacaccaattaaattgaaatctgtggggtttaatcagcatcagtggtttttaaactccccaggtgattacactaaacagccaagattgagaaccatacgactggatatgtaagtcaccgttccactccaaaattcaatgattctaaataaaatatttgaagcattctaaaaaataagacattattaatgttattgtggtcactgggccatacatttccaatgcagacaccacagtatttgactttaaaagagaaagttgaaataaagtttaaaaaaaggctgaatgcagtggctcatacctgtaatcctagcactttgggaggccgagacgggcgtatcacttgagctcaggagtgtgagaccagcccgggcaacatgggggaaaccgtctctaccaaaaatacaaaaaaggtagccaggcacagtggcaagtacctgtggtcccagctactcgggaggctgaggcgagtggattgcttgggcccggtaggcggaggatacagcaagccgctgcactcgagcctgaacgagagtaagcctgtctcaaacaaaaaaaaaaaaaaaaagaccacagtattctccatagagtgaagttgtcagacatggagatagcgggactgtgacaggataagattctttatagagggattatgcctcgtagtcctcaaacctgcttcaactgttataatctctgaccaagattacaatagggcaagatctgtgagtaatgatggttgctgatgcaagcaatgtggctttgggaaactaatttcattgtattaatcttattaatctcatcagtataggaggcgtcagaccacattgtgttatctcagtggtgcactccagctttaacctgtagagaaaagaataaacctcagtaaacctcgtgtcttgtttgctggctccagttctccttcggcctcttgaacgcggtgccatccctatccaactcgatagaggtctggcaggacaatcatctacaagaataatgagttcataaatcccaataaaacataacattctatcaagagcaaaatgcagttcagaattatgtttctgttgataaactataactatatttgagttatcactaaaattttaaccaggaaatgaaaagttttaaagtgtgtttttatgtatgtacattttaatagaacacaaagattctatatggatcaaaatttctccagcttgattgatagtttttctgtagaatatataaaatgaataacacttcttttctttttaattgaatgaatataagtttatatattttaattaagttgaaacttctttctcctttttctgctttattttacatagagtgtgctattcatagtgaaacttaaatagattgtagactattggtcaaggttgtacccaaactagaggggtgtattagttcgttcttgtactgctataaagaaatacctgagactgggtaattgttccataagctgtataggaagcatggcgacatctgcttctgaggagcccttggggaggttttactcatggcagaaggcaaacccagagcaggtgtcttatgtagcaggagcaggaccaagagagagaagggggaggtgctacacacttttaaacacccagatctcacaagaactcactatcatgagaacagcatcaaggggatagtgctaaaccattcatgagaactctcccccatgatcccaccacctcccaccagggcccacctccaacactggggaattacaactgaagatgagatttgggtggggacatagatccaaatggtatcaagggggaatgcagctgtctgtagtgactgataaggctttggtttatatcccattagggagaggttaaatgtgttttttgttgtatgttttggttagataaaatccttttaaaaaatgtaggtatgaggtaaaaggtacgtgtggcttttgcctatccaggatctgaaccctgtctctgtgtttgggaaattctccactggctgtgtgtggaaaggagcagatcccgccttttgactggaaagatggaaaagaccagatcacagaaagatgagaaaaaagccagcactcattttcccaggctgccttgcaacttgagaatgatcacatgacctagctcagccactgagaggcttcaatccagaacttcgaatcagaaacagtgatacaaagaaaaggaggctgtggagaatttattcttttggcagcagtggcagcaacactctgtttccacagatggcaggggcagcagtcctgcactgctgctggtggagtgatggctttagcacagggatccagggtttagagcagcaagcgtcctccctacactggctctttgctgtgacttagactatagttccagccgcctggctgaactaggttcctgaagatttctcagatatggtttccaacactcctgctgacttcatgaccttcccaatatcctttaaataaattccttttctacctgtaatttaaaaaacccggcatagtaaggctatagcaataactttgatgagcatacttttaggggtaaaatagcacagagaacagggaaatcctccattattttgttttgtcaaaggaatggacaaggtgctttggtcttttgtttttcttttaacttccttttccaaccaatgtttgtggccatgaaagactctctccctctgtttctctctctatatatatacatatatatatacacgtgtatatatatgtgcgtatatatgtacatatatatacacatatgcatatgtatatgtatacacatatgcatatgtatatgtatacacaaacatatatatatacacatatatatgtatatatatataaaatatagtttggctctgcgtccccagccaaatctcatctcaaattgtaatccccataatccccatatgtcaagggagagaccagttgggaggtgactaaatcacaggggtggtttcccctatgctgttatcaggatagtgagtgagttctcacgagatctgatggctttataagtgtttgatggttccccctgcacatgctctctctcacctgttgccatgtgagacatggctgcttccccttctgccatgattgtaagtttccttaggcctccccagccatgcaaaactgtgagtcaattaaacctcctttgtttataaattacccagtcttgggtaatatctttatagcagtgtaaaaatgaactaatacaatacacatgcacacatacatatatgcatgtatatgtatttcctagtctatttcataagatttcagacagcttatacagaaatatacaatataccaaaatcacattaaatgtagacaaaaatgtattgaaaggagaaaacattcacagacatataaaatagagccaggagtaaaattaatgccaggacatttacaatgatgtcctatatagttgctaaacatgaagcaatacatttgattataagcttcctagtagccaacaggtataaatgtgatcaattacacaacacatagttaaaatacaaactagttgcttgtgagaaatatatctatttctattgttaagaccagatcataattttcccaagggtctttaatagggtatagtgtaagacaattagcacaaatctcaacaaagaggggttgtaggatttttagtgcagtaggtagctatgtttggagttcctgagttacagtatatctttcactgtcttatattttgctcatgtatatgcagccatgtcacatgtgcactggggctgttcaagataaaatctgaaagaagtaaaagggaaacttacaaatattgggcgcttgttgtggaccacagactacgcaagacattttatgtagcttgcttaacttcaacaatagtttgaggcagtcccattttacagatgtatagcctgcaaagtaacttgagctaggtttccaggctagaattcacttctctctggagcaaatttcaccagtcaagggattttctcagggcatattactgttttatgtaaaagtctgtgatccaaataagcctcttatttagttgtttgtttgtttgttttgtgagacggagtttcgctcttgttgcccaggctggagtgcagtggtgtgatctcggctcactgcaacctccgcctcccgggttcaagtgattctcctgcctcagcctcccgtttgctgggactacaggcgtgcgccgccatgcctggctaatttttgtatttttagtagagacggggtttcaccatgttggccaggcttgtctcgaactcctgacctcggatgatctgcctgccttggcctctcagagtgctggggattacaggcgtgagccaccgtggccggccctaagcctcttatttgtattaattgactcaagaatattgataaagctttaacaagtttctgaagctccatgctggatgccctgggaaaacaaaagggaactaagtatagtccctttcccaactatggaactcacaacttagtgtgttattccttgtgatgttttgattaggtgagcatatatttcaaataaacatgagaattccattccaaagttctatggtcacaaatcaagtctttattctgtgttgtattacttattttaaagactgtattgtactttgtaacagcctttggctaacataatgaagtagttgactctttctaaattttacatcttcaatgttaaaaaagctctgcattgaaaattcattctcaggcagaagaatggagaaggaaataagacctaaaatacttatgctataattccagggcccttcaaaaccaaccctccctcttctgtgagcctttccctgatagtgtgcaacaaggattgaaatctacacacagttgcttctttgagtaactttaagacaatttgagaacgattgaccataaatagatatacatagataaaaatgacagatttcaaactgagtaaatattgctttggaaaacagaaacatggtccttaccgacagaaaacaggacatgcaagaccttttgagttgaggtcttgggttggagtttgagcaggcaaggggaagtaagaataaaggtgcggactattcagagaaaaaagttaaagagttgtgagtaaaggagcccagaagacagattctacttttgtgagcgaaacagtagacagcatgttgaagaatggcacataatattattgggagatggaagttggagagtgagaagccaaaatctgaaaaacagaaactatttccagatctaatctggagaaaaagccaaaagtattcatcctgtctaagcgagttttttctgctctcctgaatgtctatagatcacctttaatcaggtacattccattgtaagtgtcctaagtttcaacgttctaagaagcatttttgtgccatcaagaaaaaagaatcaattcaaatacgtcattgtgattccatcagactgcacaacttggggcttggaaacaataatggccgccagtttatgcagctaattagctgatgacctctttcagagtgacgtcaaggaagggcataaccagagtcacgaaactgcatttggcagtacaaggagctgtgactgccaaaaggtggtgtttgttgaagcgtgaaacgaaagcaaagcaagataaaaagagcttagtccttataaaaatagtattgttcttcattaatgagctctttttaatcaagtgctcttaatcaagaaagcttttctcaactaaagttttacatttccattttcaggtgagaacctttctgtgccaaatgtagacgttatcagatgaggctcaataacttttattggaatgctagagggggtttatcattttaattgcttctgtctcattaataaaagatacaaactttatactcaagataaattttagtttctagaatttccacaggctgtaatggatttctttattcatccaattcaataaccatttattgaatacctactctaaacgaggccctgcaccagacactcactagagatgcagaggtgagtgagacacagtcctggctctaagaacctcacaaagcctttagggaagaaatatcaactcaatcattttgatgcaatataggaagtgcaaaagtttgcggtaaatataaagcattgaggtgttccgagaaaggaggaatgaacactgccttgggatgggaggagggaatggagaatggcaaagattaaagtggccaccaccaaatggaaactcaactcctgaatatggcatataaatgaaagcaaacaccccaaccagcaggtaccaaccttcagccatctttatatgaatttaataatttttacatatctacatattgtttatagcactgtttacttgatatgattttttaagatgactcttttaaaaaaattaattggactggccgcggtggctcacacctgtaatcctagcactttgggaggctgaagtgggtggatcacctgaggtgtcaggagttcgagaccagcctggccaacatggtgaaacactgtctctactaaaaatacaaaaattagccaggcatggtggcaggcacctgtaatcccagctactcggaaggctgaggcaggagaatcacttgaacccaggaagtggaggttgcaggtgagctgagaccatgctactgcactccagcctgggctacagagcaagactctgtctcaaaacaaaacaaaacaaaaacattaaattgtctgtgatgtgcaattacatttctctaacaatatttgcagtgagcaatgttgcctgcagatcactttttaacatgtttgtgtcctctctcagcttcagcatgcttttgcttcccacagtcaacactcgtgacttttctttgaccaactgtacttcagctaatggggcaactttgcctacactcgcagagccctagtacctgagaatgtaagttctggaggtggcatttaaccaatgcctgagaggtatgggaatatgaaagcctagctccattacttaggtttgggggagttcccctgggagagcaggatgaagctcctaccctttgcaaaactttgccttagatttcacccttccgtgtcctacccccacctttctccataccagtctcgcctggggacacttccttaataaatccctggcctacaaatcctagtctcagtatctgcttctgaggacttggatttaaggaaaaaaaaacccctcccacccccatctccctgccttgctaaaaaagaaaaaatgttcctccttgtactcacaaaatatcttggccatatatctcagcggtacacacagctcaggaagcactcatctgacacagctacatgcaactccactgaacagaaaacctagttctatggcgatactttatattcctctccaaggaggggctatttaacgggactgattctcttgttagaaagcagtcttacttttcagctgtatcatctctattaattttttgttatcttcaatctttttttttttttttttttttttttgagacagagtctctctctgttgcccaggctggagtgcagtggcacaatctcagctcactgcaacctccgcctcctgggttcaagcgattctcctaccttagccttctgagtagctgtgactacaggcacacgccaccacacccagctaatttttgtatttttagtagagacggggtttcaccatgttggccaggtctcaaactcctgacctcgtgatccacccgcctcggcctcccaaagtgctgggattacaggtgtgagccacggcgcccggcctgttgtctttaatcttttacctacctatttttgtcttccgctagtcctctgcccattctgcctgcctcaggccaactctgtttgattccccactttccgaacgaacctccattttcacgtgcctacagttctttacattggaaaacaaatttctctgccctgtttagaataatctttttaacctagtcattctcttttggcaagctttattaattcttatgagttatttattttttgtcatttttcttaataagattatagatatctgaaatcattatatatatatatttttgttttgttttgttttgtttttttttgttttggagacagaatcttgctctgtctccaggctggagtgcagtggtgcagtcttggctcactgcaacctcttcttcctgtgttcaagcgattccactgcctcagcctcctgagtagctgggactacaggtgtgcaccaccacgcccagctaattttttgtattttagtagagacggggtttcaccacgtcggccaggatggtctcgatctcctgacctcatgatgtgcccgcctcagcctcccaaagtgctgggattacaggtgtgagccaccatgcccagcctgaaatcattatattatatatttttgtttatttgcttatcctctaatgtccccactagaagttaagctccaaagagtagcacttggcttatcatgttaccactgcacctgtgcctaaaacagggcccagtgttaggtaataacactcaaatatttgttgaacaaattgtgtgatattttcaaaaacataatttcaagttcaattctctattagaattcttcctttgattattcaatatacctatatatgtctatcatgtttgtgtaggtatgcctgtaacttttttattaaataaaaaatatgaggaaatggaccactaatccattgtggtcatctctgaggatagaaagtcttcagcaaatcaacttttatacccaaaatacgtatgtgtatataattacattttatcatcaataataatagtagaatcaagactgcctacaaaactactaataattatgattttttcttgagtctcacacacaaattctctgtcttcagttcatggacatctttcaacttccaaatatatttgaaatggaagtggaaattttagaaagaaaagtagaaattttgtaagtaaataatataataattgaaataaaaagctaattgcaaccaagtgttggcagagatgtggagcaactggaacattcctacagtactgcaaggagtgtgagattggtacaaccagtttggaaaactgcttaacagtgtctactaaaattgaacatatgaatatcctaagacccaaatttccatttctagatatatactcaacagaaattcatacatctgtccaccaaaagacatatagaaaaagcatttgctacagttctgttcaggatatcaaaaaattgtaagtagcccaactgtctgtcaacagcaaatagataagtaaattgtggaacattttaataatgaaatatattaatgagaatgaacaaagtaaacaaacggcactaagtgcaacaacatggccgaatatcacaaacaccacgtcaggcaaaagagccaaacacaaaagcattcatattatataactccgtttatatatagctcaaaacaaagctatcattttagaagaaaagacagaggttatccttgaggagtaatgctagaatagaacttctggagtgctaataatgttctctttctttatccatatgctggctatgtgagtgtattcactctttgaaaagtagaacatgtagacacatggaggggaacaacacacactggggcctgtgggagggggttgggtgggggagggaaagcatcaggaagaacagctaacggatgctgggcttaatacctaggtgatgggttgctctgtgctgcaaaccaccatgacacacgtttacctgtgtaacaagcctgcacatcctgcacagataccctggaacttaaaataaaagttgaaaaaaaaagtaattgagttgaacaattataattggacacttttctgtactcatgtttatatttaaataacaattttacttaaaggaaaaaaaattcaataggaggtttacagaatagcttagattcagtggtatgctggtaaactggctttgagaaaaaaaaaaaaattaaagccctgatttgtagtatttgcaaaacactatattgtaattattctcatcatgtttgaggttagattatcaatggttttacaacaagttcatgaaagtcctgaatatttaataatcagatctcacaggttggaatgaggcagttccaacacaccaatgagtcaacactgatggaagaattaactctagaaatgctttttacattacagttaactcatgttctttaagtctagatatgccttttgccttataaaaataaaattactatattataaaagtttcaatttataaaaatgatatatagcctaataagaaggcacggtggctcactcctgtaatcccagcactttgggaggccgaggtgggtggatcacctgaggtcaggagttcaagaccagcctggccaacatggtgaaaccccatctctactaaaaatacaaaaattagctgggcatggtgggggatgcctgtaatcccaaccactcaggagcctgaggtaggagaatcacttgaacccaggaggcgggggttgcagtgagccgaaattgcaccattgcactccagcctggacaacaagagcgagactccatctcaaaaaaaaaaaaaaaaaaagaaagaaagaaagattgcttcaaaatatataaagcaataatggacaaagctacaaggaaaaatgcataagtttattatcataatgggctatttggacatatatttctctgcaattgatggaaagtcaataaaattctataaataacagttgaataatactaaattgaaagtttaccaacagaggccaggcacagtggctcacgcctgtaatcccagcactttgtgaggctgaggtgggaggattgcttgaggtctggagttcgagactaggctgggaagcaaagcaagactctgtctctacaaaaatttaaaagttagctgaacatggtcatgtacacctgtagacccagctacctgagaggctgaggtgggaggactgcttgagtctaggagtttgagactgcagtgagtcatgattttgccactggactccagcctgtgtgacagagtaaaatcctgtctcaaaaaaaaagaattattaatgagtatgtagaacattgattccacttcttcagaatgcacattcttttaggaaaaagtatatctcaacaaattttaactaactggtatcatataaaaaaaaaatcagcaaactatgctgtgtaggccaaacccagcttgccatctgtttttatagataaagttttattggaacaagtcatgcccgtgtgtttatgcattatctgtgactggttttgcactgcagtggcagagctaaataacagcaacagagaaaattatatgctattgggatctttattgaaaaattttgccaacccctcgatatagactgtattatttgaccatagcataacaaaataaaatagtccaaaaaaagtttggaaacttaaaaacacaattgtatataatacataggtcaaagaagaaatcaaaagggaagttggaaaacaataaaagttgaacaataacaaaaataatacaaaacttgaagaaagcaactacaggagtacttggaaatgcatatccttgtaggatttaatagaaaacagggagacttaagattaatgaactaagcatccaaattcaaaagtcaggaaactacaggtttaaccaagcagtggtaacagggattggatataccctcttgcataaaacaactaataattggataaaacatatgaaacaatgattttcagacactggacatgaggtaatagaggatgatgatcaccaaaagataggaacaaagtgagacctacaatttgcctcagcttaatggccagagaaatgtttcatgctgaatcacagacaaaggcaaacctggtggggccccgcagccttgttgacttgaaatgaatctgagagtctaaagagaccaaagaggccggatctcacaggacgaagtatccgagaggaaagagcctcacagacagacagctccagcttcaactggactaatgcatgtataatcgaagtcccagaaagaggggagagggattggaaaagaaaaatattttaagaaataatagccacttcatggctgggagccgtggctcacgcctgtaatcccagcactttgggaggccgaggcgggtggatcacgaggtcaagagatcgaaaccatcctggcaacgtggtgaaaccccctctctactgaaaatacaaaaactagccaggtgtggtggcacgtctgtaatcccagctacttgggaggctgaggcaggagaatctcttgaaccagggaggcggaggctgcagtgagccagcatcacaccactgcactccagcctgggtgacagagtgagactctgtctcgaaacataggaataaaaataaaaaagaaataatagccaattaatagaaacagaaagtagaatggttcctgctaggggttgggagtgggtgggaagttgtttaagggatttggagtttcagttgagaagatgaaaaaagttctggagatggatggcggtgatggtacacaataatatgagcacacctaatgccactgaactgaacacttaaaaatgatgaagatggtaaattttatgttagtattttttgtcacaataaacaaataatggccacaaagtttccaaatatgatgaaaactatgagcccacagatccaaacaccaagtacgagaaacatgcataaaatgacactaagacaaataataaaaatcactgataaagacaaattcttaaaggcagccagagaaaaaagatgcccaatttataggcagtctgatggcaaacttcttgtctgaaacaatggcaacaagaagacagctaagtaacattttttaaggcctagaaaaaacctctagtaacaagaattctataaacataacaaacatctttaaaaaaaaaaaggcaaaataaacatattttagacatacgaaagccataagaattcatcactagaagaccttcccaaaagaaacccattttacatattaatatataaatagactaaagtaaaaggattaaaaattaataccagctaacatttgccaaatgaaagctggagtggctatactaatattagacaaggtagatatcagagcaaacaatattaggataaagagggtcattttgtaatgaaaaaggggccaatttatcaagaagacatgacaatccttaaatgtttttgtatctaatgataaaatttcaaaatatatgaaacataaccagatatgactgcaaggagaagtagattaatacacgattacagtgtcttagttctcttttgctgcataacaaattactacaaatttaacactgtaaaacaaaatccatttattatctcatagttctgtaggttagaagtctggcattgcatgactgggttctcgacctaggctctcttgaggctgaaagcaaaaagaaaaccaatcaaaacgctacactttaactttgttcccctgatttttaactttttgtcatttctctgtatgtatcattgactgtccatgtcttgaaaggttgttgtagttattatttttgatttgctcattgtttagtctttctacttgagtagtttacacaccacaattacagggttatgacattctgtgcttttctgtgtacttactattcctagtgagttttgtatcttccgatgatttcttattgctcattaatgtccttttctttcaggttgaagaatgccaattagtatttcttgtaggacaggtctggtgttgatgaaatctcgcagcttttgtttgtctgggaaaatgcttatttctccttcatacttgaaggatgtttttgccagacatactcttccagggtaaaagtcttttcccttcagtactttaaatatatgatgccactctctcctggcctgtaaggtttccactgaagagtctgctgccagatgtattgaagccccattgtatgttatttgtttcttttctcttgctgcttttaggatcttttctttatacttgatctttgggagtttgataattacatgccttgaggtagtcctctttgggttaaacctgcttgtgttctataaccttcttgtacttgaatattgatactttgtctaggtttgggaagtactctggtgttatctttttgaataaactttctacccttatctttttttctacctcttctttaaggccaataactcttagatttgcccttttgcggctattgtctagatcttgtaggcatgcttcattctttttcattcttatttcttttgtctcttctggttgtatttttaaacagcctgtcttcaagctcactgcttgtttcttctgcttgatcaattctgcttttgagagactggtgcattcttcagtatgtcaattgcatttctcaactccagaatttctgcttgattctttttaattatatcaatctctttgttaaatttctttgatagaattctgaatatcttctctgtgttatcttgaattttttttgagttttctcaacacagctattttcaattctctgtttgaaagatcacatatctctgtctctccaggattggcccctggtgctttgtttagtttatttggtgagatcatgttttcctggacggtcttgatgcttgcggatgtttgttggtgtctgggcattgaagagttaggtatttattgtagttttcacaatctgggcttgtttgtgcccgttcttcttaggaaggctttccatatattccaaaggacttgggctccaagcccaataatgctgtggttcttgcagattcatagtggtaccgcttggtggtcttgaataagatccagaagaactctctggattccttaatgttctcttcccttactttcttccaaacaaatggagtgtcttgagtaataccccatatgcacaggtaaccaaataaagaatggacaaatggaatcacagcaagttaaaaagcttctgcacagcaaaggaaacaattaacaaagtgaagagaaaacccacagaatgggagaaaacatctgcaaactttccatctaacaagtgattaataaccagaatatataaggaagacaaacaactctataggaaaataatccaattaaaatgggcacaagctctaaatagacatttctgaaaagaagacatacgaatggcaaacaggtatatgaaaaggtgctcaacatcattgattaccagaaaaacaaaaatcaaaattataatgagatatcattttaccccagttaaaatggtttttatccaatagacaggcaataccaaatgctggcaaggatatggaaaaaagggaacccttatacgctgttggtgggaaagtaaattaatacaatcactatggaaaacagtttggagtttcctcagaaaactaaaaatagagctaccatatgatccagcaatctctctgcttggcatatacccaaaggaaaggaaatcagtctgtcaaaaggatatctgcatgcccatgtttgttggaacactgttcagaagagccaagatttgtcagcaatctagtgtccatcaacagatgaatgaatcaagaaaatgtggcacatagacacgatggagtactattccaacataaaaaagaacgagatcctgtcagttgcaacaacatggataaaactggggatcatcataagccaggcacagacagacaaacttcgtatgttctcacttatttgtgggagctaaaattaaacaatttcaattaattagttattttaactaaaacaactgaattcatggagatagagagtagaagggtggctaacagaggctgggaaggggagtgggggtgggggtggttgagggggaaacgtggatggttaacaggtagaaaaatatagttagagtgaataaaatgtagcatttgatagcacagcagggtgactacagtgattctttataacacaaagaaagaatgaatgcttgaggtgatggatacctatttattctgatgtgattattacacactgcctgcttgtatcaaaatatctcttggaccctgtaaaaatatgcacatactatgtacccgcaaaagttaaaaatttaaaaaatcaaaaggaaaaaatggaaggataaaaagttaaagatatgccagttaagtcactagttaaatgtatatcagtctgtttgtattactgtaaagggatacctgaggttgggaaattaataaagaaaacaggtttgtttggctcatagtgtcgcaggtggtacaagaatcatggcaccagcatccgtatctgatgagggcttcaggaagctcccacttatggcgaaaggcaaagggggaagctgcatgtgcagaaatcacatggccagagaggaagcaagccgggaagggagatgcagtctcttttaaacaaccagctctcatgggaactaactcactcactaccacaagagtggcaccaagtcattcgtgagggacctgcccccacgaccccaacacttcccaccaaatcccacctccagcattagggataaaatttcaacatcagggccgggtgcagtggctcacacctgtaatcccagcactttgggaggctgaggcaggcggatcatgaggtcaagagattgaaaccaccctggccaacatggtgaaaccccatctctactaaaaatacaaaaattagctgggtgtggtggcgtgtgcctgtagtcctagctacttgggaggctgaggtgggacaatcgcttgaacccaggaggtggactttgcagtgagccaagattacgccactgcactccagcctggtgacagagcaagactccgtctcaaaaaaaaaaaaaaaaaaatttcaacatcagattcagaggtgtcaaatatccaaactatagcaatgtaattttgaaatctagctgagcaaattttagctgaagttccttgattgggcttcatggactgggaataatcatccacatccctgccatacaggctctcagctcctgctgacgcactctgggtttcaccctatgagtcattattttacagctgagcagttttatcagactgctttctgtctgtagaatttgtgatatctgatattcttctttcattttgtacacactctgtcccctttggtccaagctgtaagtgtttctgctggtatgaaattctcaagaaccatatgggtcttgagttgatttattccattcaaagaactaaacccacagatcttttggatataatcttttttttttttgagacagtgtctcgctgtgtcaccaaggctagtgtgcagtggtatggccatagctcactgcaaccttgatctgcaggctcaagcaagcctcctgcctcagtttcccaggcagctgagaccacagacatgtaccaccatgcccagctttttattttattttgatttttattttttatttttttttgtagaaatgaagtctccctatattggccagactggtcttgaactactgggctcaagtgatccttccatctgggcatcccaaattggtgggattacaggcttgagccactgcgcccagctaatcctttttctatattttgtttctactatgacggctgagggacaatgctcttaggctttctagaagacttccagtttgattgagaactatgaggcacactgttaatctcttgtgaataaatactttgccattttgatcagtccaaggttccagcaaagagttgtaaagtcacatttttggcatttatttttctatgccatgctttcaagagacatttctaaattttagtgtcttttgcaatctggataggccccagaattttctaaatctagtcctattttctttttatgtaacaattcttccctagccaggtgcagtggctcatgcctgtaatcccagcactttgatccactgagatgggtggatcacctggtgccaggagtgcgagaccagcttggccaccatggcaacatcctgtttctactaaaaatatgttttaaaaaaattagctgggcatcgtagcacatgcctgtagtcccagcgactttgggaggctaaggcaggagaactgcttgaatcctgtaggtggaggttgcagtgagctgagatcacaccactgcactccagcctgggtgacagagcaagactctgtcacaaaaaaaaaaaaaaaaaaaagttcttctccaatcctgttttttttctctcacattttactataagcagcaagaagaaatcagaaaacaccttcactgcttggcttggaaattacctcaggtaaatatttaaatttattacttatgagttctgtactccaacatcactgtaggacataattttgctaaaaattctgctaacatataacaagaatcttccttcctcctgtttcaataatatgctcctcactttttttctaaatcctcaccagaagcattcttaatgtccagatttctattaatagtttgctcatgatgatggaggctttctctaaggcagtttaggatttctctataatcttcctcatattgttctgagttcccaacagcaatatttttaacatgaatatttctattaacagtcttcttctattcaaggcagtctaggcttttactaccatgctcctcagaatttttacagcctccacccactgtctgatttcaaaaccaattccacatttttagacatttgttgtgtcagcacgtaattccaggtaccaaaatctatactcatctttttaactgctatgtaacaaaataaccagaaaattagtggcttaaaacaacactcatttatcatttcacagttatgtaggtcaaaagtccaaaatcaccaataggtctgtgtttcttctggaggctctagaggccatttgtttccttttccagcttccagaggctgccggtatttattagctcttggccctgaatctattaaaatataatatgactttcttgttgttttctaccaagatggtttattattctttttatatatggctggatttgatttgctaaaatatggttaaaaattattgcaatgatgtctgtagttttctcttgttcttttttttagacggagtcttgctctgtctcccaggctggagtgcagtggtataatcttggctcactgcaatctctgcctcacgggttcaagtgactctcctgcctcagtcttccaagtagctaagactacaggcgtgtgccaccacactaagctaatttttgtatttttagcagaggtggggtttcaccatattggccaggctggtcttgaactcctgaccttgtgatccatctgcctcgacctcccaaagtgctgggattacaggcgtgagccactgtgcctggccagttttctttctttttaatttttttttcttttttttttggtatcagggtactactgttctcataaaagtagttggtaagtgtgtcctcttctttaacatgttctgcagagattaaagaagatcctaacctcttatctttcagtgaccttgagggtctgtcaagtaggaaataaaggtgacggcagggttgtccactgcctggctgagtggtgaagtcataccccaatatgcatctagagccctaggcaaagactgggagactgattagctctaggtgtttaagaaaatctgttcgttattagctgaccactaggctaaccatgcaaaaaaaccagtggccatacatgaaaatgaatataccctttacagagttagttcagaaaagtcactgaacaaacagcaacaacaccaaaccacggggagagagaagaatctgagttccagagataccacattatattattttaaatgtcctgtttttgacaaaaaattatgagacaacaaaaaaagaaagtatggtccctatgatgggaaaaaagaaatcaaccaatgaaaacccaaggaagccaagacattggacttactagacaaagactttatatcagtgaactgaaggcagccatgtgtaaaaagctaaaggaaaataggaaaattctggttatttaaatagagactgtaaataaactgatagaaattattttaaaaagaactaaatagaaactcttccattgaaaagtaaaataactaaaatgataaactcactagagagtctcaccagatttgagcaggaagaataaagaaatagaacatttggaaattggtaaattgtttattcagtatttttaactgaaaaaaaaatgaaggaaaaagtgaacagagcctcagagacccatgggacaacatacacataacaagagtctcagaaggaaaagagaaagaaaaggaggcaaaagagttttaaaaacataatggccaaaaacttctcatttgatgaaaattattaatctatccatccaagaatcctaatgaactccaagtaggataaaatcaagtcagtccacactgacacacatcgtaagtaaatttttgagaactaaagacaaagaaataatctttaaagcagcaggggagaagtgattcatcacatataaataatctcaataagattaacagttgattcttacaaaagaaattatggaggccagaatgcagtggtatgacattaaaatactgaaagaaaaatactgctaaccaagaattctgtatctggcaaaaccatccttcaggccaggtgcagtggctcgcgcctgtaatttcagcactttgagaggccgaggtgggcagatgacttgagaccaggagttcgagaccagcctggccaacatggtgaaaccacatctttactaaaaatacaaaatttagccaggcttggtggtgtatgcctgtaatccccacttctcaggtggctgaggcatgagaatcactccagaggaaattacataggtaaatataaaagacagtataaatgtatttgttggttgtaacttttatataactaccttactaaaatgataactgtataaaataacaattctaaatatgtgttgatgggcataccacatataaatacgtaattgtatgataataacacacaaaggaaggggggagaaataaagctattttggaacagtctttgtatacttttgcaattatgttgctactcatccaaactagatttttataaattaaaatgttaattgcaatccctaggactacaactaggaatataagtcaaaaatatataataaaaagaaatgacaagggaattaaagcagtgtattagaaaatctctctttaggccaggcacagtggctcacacctgtaatgccagcactttgggaggtgggtggatcacgaggtcaagagattgaaaccaccctggccaacatggtgaaatcccatctcttctaaaaataccaaaattagctgagcgtggtggtgagcacctgtagtcccagctactggggaggttgaggcaggagaatcacttgaacatgggaggcagaggttgcagtgagcaaagactgtgccactgcactccaccctggcaatagagcaagactgtcccaaaaaaaaaaaaaaaaaacaaaccagaaaatctctatttaacataaaagaaggaagtaatggacaaataggggaacaaaaagacatatgacatgtcaaaagcaaatagcattagaaattttattcatgcagaaacctacatatgaacatttgtagaaattttattcataattgcttaaacttagaaaaaactagaaggtctttcagcaagtgaatggataaacaaatcatggtacattcatacaacagaatattattcagtgctaaaaagaaatgagctattgagctattatcacatactttacctttatccccattctttgagaactacattcttacatatattagaccacctaaagctgtcccacagctcactgatgctctgttcttttctcattttaaaaaaatctctgtgttttagctgggtgtggtggctcatgcctgtaatcccagcagtttaggaggacaaagcagaaagatcgcttgagtccaggagttcaagaccagcttcggcaatatagtgagaccctatctttacagaaaataaaaaattaactgggcatggtggcacacacctgtagtctcagctacttgggaggctaaggcaggaggattgcttgagtctagtgtgtcgaggctgcagtgagctgtgattgtgccactgcactccagcctgggtaacagagtgagaccctgtcccctgattccccaaaaaaaagaaaagaaaaagaaaaaaaaaacaactctgtgtttcatttagattatttttactactgtgccctcaagttcactgaacttttgcaatagctgattttctactaattctatccactatattttccatatcagatactatattttttattcctaacagtttaagatctttttaatattttccataaaatttcttaacatacttacattatcttctttccttgaatttgtggagtatatttataataattgctgtaatgtctgtgtctcctagtgatattatttgcatcacttccgagccattttccattgattgatttttctccctattatggtttgtatttttctgcttctttgcatactttgtacttttcaattagacattgtaatttgtttaccttgttggttgctaatgttttttgtattccttaactatccgtgagctttgtatgggatgtagtaaaattgtttataaatattttgatccttttgaggcttactttcaagttggtcctgttatgaaggatcaaaacagcctttaggcagaatttttcactgctactgaggcaatacacttctgagcgctctacccaatgccttgtgcattattaggttttttcactctagctggtgggaacattaactcttcctggctttctttgttccagaggtagttctgcccactcctttccagtagttctttccccatagtttcgttacacacacacactaaccaagactaacatgaacagttgaggaaaacctgcggatatcaggtgctctctgtgcagctcgctcttttatctgcagtactttctcctacgtactattttattctatgtgattttgtcatcttggtgtcctcaaattctcaactctgcctcatcctagtgagaagagcatggtctgagttgctcctccctacagtgcatccttttaatttttttccaggcagtacactaagtatattagtccattagcatactgctataacaaaatacccgagactgggtaatttataaagaaacaaggtttaatgggctcactgttccacaggctgtacaggaagtatgggtggggaggcctcaggaaactttcagtcatggcggacggtgaaggagaagcaggcacctcctacatggcgggaatgggaggaagagagagagggggaagtgttacacacttaaatagccagatggcgtgagaactctatcatgagaactgcaccaaaggggaaaatccacctctgtgatccaatcgcctcccacccagccatcttaattctaacactggggattacaatttgacatgaaattagggtgggaacacaaatccaaaccatatcactaagcaatgctaaggttcacctaatttgattcccttcactaagagatccttgttctatgcggccttgtgtccaaaactatattttgtgggttttttctttttctttttcttttttttttttagttgtttaaggtaggcaggtgtaacggttaattatatgtatctacctgaaggatgtttttggaggagattaacatttaaatcagtgaacttggatgggcctcatccaatcagttaaaggcctgaatataacaaaaagactagcctccctgagcaaaagataaaatttccagccagctgctttggacattatctgcatcattggcttccctgggtctctaggttgccagccttcagactagaatcacaccaccagctctcctgagtcttaagcctgccagcctgtattatggattttggatttctctgccttcataattgtgtgagccaattccttataataaatctctatagatatataggtcctgggccgggcgcggtggctcctgcctttaatgctagcactttgggaggctgaggcaggcggatcacctgaggtcaggggtttgagaccagcctggccaacatggtgaaaccccatctctactgaaaatacaaaaattagccaggtgtgatggcatgcacctgtaatcccagctacttgggaggctgaggctggagaatcgcttgaacccagcaggtggacgttgcagtgagccgagactgcaccactgcactccagcctgaacgacatagtgagactctgtcttaaaaaaaaaaaatatatatatatatatatatatatatatatatatatatatatatgtgtgtgtgtgtgtgtgtgtgtgtgtgtgtcctatatagatattaataagataggtatatagatatacagatcctattggttctgtttcttttctttctttctttttttttttttttgacggagtttcgctctgttacccaggctggagtgcagtggtgtgatctcagctcactgcaacctctgcctccagggttcaagccattctcctgcctcagcctcctgagtagttgggactacaggtgcccaccaccacacctggctaatttttgtattttgagtagagatggggtttcaccatgttggccaggctggtctcaaactcctgacctcaagtgatctacctgccttggcctcccagagtgctgggattataggcctgagcctccatgcccggcctggttctgtttctttggagaccttgactaaagaagaagacaaatctgttccatgttattcctccatgactggaaacaagttcatgatgcatttgaaagctatagcaattaagatggtttggcaggctgggcacattggctcacacctgtaagcccagcactttgggaggccaaggctagtggatcactgagatcaggagtttgagaccagcctggccaacatggtgaaaccctgtctctactaaaaaatacaaaaaaattaactgggtctagtggcacacaacctatagtcgcagctacttgggaggcagaggcaggagaatcatttgaaccctggaggtggaggttgccatgagcagaggtcacgccactgcactccagcctgggcgacagagcaagactcctcaaaaaaaaaaaaaaaaaaaaaaaaaaaaaaaaaaagatgatttggcatttatgcgttgcaaaaaaaaaaaaaagagagagagataatggactaacatagccctaaaacagatccataagtctaaggatgctttacacatatttagggtgccattatagattactggggaaaggatggtcactcaattattgctgaaagaatattttatttgtatatataaaaaaagtgttacatgataaccaaaaatccattttatacgaattaagtactttaattaaatcttttagaaaataatgttgaagactttcataacctctgcctaaaaattcatctcaaaccaggccccaaaagtacaaatcataaaattactatattttaaaaagtaaaaatcaaccccaaaattcataggatatatatgcagtacacatagcagtcaaagattaatattctgaaaatatttactcattaaaatcaacaagataaataactttgttttttttttaggatacaaggtcttggctgggcacagtggctcatgcctgtaatcccaacactatgggaggataaggctggcggatcatgaggtcaggagttcgagaccagcctgaccaatatggtgaaatcccatgtctactaaaaatacaaaaattagctgggcatggtggcgcacacctgtaatcctagcaactcaggtgtctgaggcaggagaatcgcttgaacccaggaggaagagtttgcagtgagccgagactgccccactgcactccagactgggtaatagaggaagactccatctcaaaaaaaaaaaaaaaaaaaaaaagaaagagacaaggtctcagcatgttgcccaggcttgtcttgaactcctgggctcaagcaatcctcctgccttcgcctcccaaagtgctagaattacagacatgagccaccatgcccagcccctaaattaaaaaaaaataagtaagatactttaacagacacttgccagaagacaaaacctaactggccagtgaaaatatcaaaatatgttcagcctcattagcaattaggaaaattcaaatggaaacactatggaatataattttatacccatgagactgacaataatttaaaaagactgacaataaggattgatacgtggtacaaaaggaaatactactactcataaatgcatgaattcggacaataactttgaaatacaagttggcatttctttgtaaaattgaatcattcttataacataatagttctattcttaggaggaggaattcttgacacatgtatgcatcagcagccatgtaaaagagcatcattgtttgtaaaaggaaaaaaacaacaactgaaaaatattccagaagtccattgataggatagtgggaaactaaactgtgatgtatttgtgtatctgaatacagtcatgtgtggcttaacaacagggatatgttctgagaaatgagttagacaatttcgtcattgtgtgcacatatcataaagtgtacttacacaaacctagatggtatagcctactacacacctaggttatggaatatagcccattactcctaggctacaaacctctatagcatgttactatactcaatactgtaggtaactgtaacacaatggtaagcatttgcgtatctaaacacagaaaaggtacagtaaaaatatgatacaaaagataaaaaatggtatggctgtgtaaagcacttaccatgaatggagcttgcaggaagttgctctgggtgagtggtgagtgaatgggaaggcctaggacattactgtacacttaggctatatttaatttatttaaaaatatagtaattgcactagaatgttatcatggctacaacatcactagacaataggcatttttttcagctgcattgtacactgttgtgcatgtggtccattgttgactgaagcatccttatgtggcacatggctgtacttttcaacagataaaataaggaaactacaactactttcatcaacatgaatgaatcatgaatataatggtaaaatttaaaaagcaaattataggagaataatacattgacattgtttagacaacattcaaagacaagcaaactatacaatatatattttatatataaatacatgagtaacatgtccaaaggataataaaactcaggagggcgattatctttggggagaatgtagagaatgtgattagggaagtgaaaaaagggtttagtgataatgacaacattttgtttcttaagctggtatatgggtgtttattattatgctttataaattataagttatatacattccatagttaccaggggtttcataaatttttagaaagctgattaaggtaaatcactggactttcttgctaatataaatgtatctggtatctgtggctccaaaccagaatatagttctaaccaacttcaaatgaattagacttacagaactacacattctagagatgtgacctgtgaatatcgaagcatccattgttcttaactcacgtcaagcaggagagtactgagatggatgacatgtttgtgagcttatttgtggaccctctccaagatgttaattctcttagttgatactttaacaatctgtactatccacaatggttttaaatagaataatatatttaccaagaaggaaggtggaaaaagaaattgaagaaataacaaagacaaggaagaaggcgatcatagtgaaagagatgagaaaattaagataattccaagtaggaaattaagtcaagaggtaaacaggagaaggtatgtcccctagcaattccagaaagtacacgctgggtttccaatagtgcttagaatgagggttcaagccatttatttaagttttaaaagaagggatttattgagtattatatatggaccctatatccaagtactgataatgaaccttatttgtcaacattggtcctttaatacctgttctatttcaaaaattaaattgttgatccctatttacttaaatatctccattaatttggttctgattttacttcagaaggaaggtaaaaatgagaaaagtagaaaattaacctttttaaataataatgacattagcaatattaccaactagaagtccccttttctcatctccttgacacagacagcccaaataatgaatgagcaactacattttaacaaataactaagggagtgtgacggagtacatcaaaggatttaacagaaaccctgatgaacacagaaactcaggatagccacacagagaacagaaggaaacagcaggcttccagcaccccatcccctagctggtatcagctgggaaccaggaagaacttctccctatggcaaggaggttaaggaagcccccatcaacacctttgacacctactgttctcaccactggggtcccctgcagtcctcacactgtgcgccacctcctgtggcttgcatggcgataccttgagcgcaggtctcaaacctttggagcatcccttcttccctggagtcaggccaagactgtgccctgcctgccctggagtagaatcacagccaaccttaccctccttgacccaagctctagagggtgtctcagtgtgcaacctacagtcaactttaacacagagagaaaacctgcaccccaaaactcaggtgccacaatagctttgcactaagacaagccgtgagcaactgtttcccccttccctctggggttgggcagcagtggaactgcttcacttactcctcctccctttactccctcaggccagagcagaagctgtgcactctctcttggggaaatgatgctttggaagaatggttccatctaccactctcagctctggctatgtcctaccactagaggcctgagctgaaactgtgcaccgctttctgaggaaacagtgctttggtggaggtctacatcctggaaaaatggtgtagggaccacccagaacagtcatgtcccccaggtctaagctgaaatggcacatcacccccttgggaattggtgccttggccaagttgagtagctgtgtagtccagggctgagttgatgtagtaccctgtctcccagggaaacagagcagtgtctcagttgagacactttgtcctacaggccaaaaatctctaataacctgcttccttggagaggaactagggctctagatcctgagctgctaagatacccctctccctggggagtggagtcatcactgtgctgctccctgccctccagggcctaaacaacagctgtcctcatccattctagggtacttgctactgctgcacccagcctcaaagtatctgagatactgctgagccccaccatcccaggatttaggatcactgctacatggtgcctcatcgttaaggacctatccctaacgacctaggttgcccacgagccctattggtttagacttctgaattgcagccataccctgtaccgtggtctcaaacctttagagtagcccttcttccctggtgtcaggtcagggctgtgccctgcccctctggaacagaagcacagctacaacctgaccccctggacccaagctcctagggagtgccttagggtcagagacacttgctcagtgtgcaacctatattcaaccttaccacacagaaaaaacctatacccccaaactcagctgctacaatagctttgcaagaccctgagcctaggcccctgccccagagccactccaaacatttgcacctaaaacctggaacccagcaccattgtagctgcttttaggatgtgtcagacttgacaccaggagggctctcctcacctaagtcctcttattgtggggaaaatgaatataaagggagcccaaaggcccttgctgcaaaggacattaacaactgatgccaccactgctgttacttcagacttctacagtctaagccactgaggcatccacagctattgctgatactgaacacagccaaagaagttgcatggagatcatatcaccatacctggaatgcactctagaaacaaagttgcaacacccttccttcaaccagcatgctaagacacaattatggttgcaagtccttctgtaagaaagcctctttagaaagtttggaagaggtgattgttccatcatgtgcacgaaaataaatgcagggacacaagaaacatgaaaaagcaaggaaatatgacaccatcaaaggagcataattctgtagcaacagaccccactgaaaaggaaatccatgaattctcagaaaaagaattcaaaatgatgatattaaggaaactcaatgagatacaagaaaatacaggtaggcaattcaatgaaatcaggaaaagaattcatgatatgaatgagaaatccaacaaagagatacatatctatcattaaaaagtcctaagcataaattctgcagctgaagaattcaatgaatgaaataaaaaatatgtttagagagcttcaacagcagatttggtcaagcagaagaaagagtctctgatcttgcaaataggtcatttgaaatacccagctaaagaaaacaaaagaaatgagaataaaaaagagtgaagaaagcttataagacttatgggatagcattaagtgaacaaatgttcataacatgagaggtccagaagaagaagagatagaaaaagcatagaaaagcctatttatgcctcagaagaaggagcaaatgaaaaaaaaagaaaacctatttaataaaataacagatgagaacttcccatctggagagagatatgaacatccaattcaggaagctcaaaagttcctaaatagattcaatccaaaaaggtcctcaccaagacacattatagtcagattgtcaaaagtcagagacagaaagaattctaagaacagcaagagaaaagcatcaggtcacatacaaaggaatccccattagactaacagcagatttctcagcagaaactttataggccaagagagaatgagatgatatattcaaagtaatgaaaaaaaaattgtcagccaagaatactatacccagcaaagctattcttcagaaatgagggcaacataaagtttttcccaaagaagcaaaaactgagaaaattcatcaatactagatcagccttacataaaatgctcaagggagtatggcatctagaagagaaaagacaataattgccctcatgaaaacatgcaaagtacaaaattcactggtagagcaaatacagaaaggagaaagagaaaagaatcaaactttatcactatagaaaaccatgaaactgcaatgatgaacagtaagagaggaacaaaggatatacaaaacaaccagaaaataattaacaatatgacatgagtaagacctcacatattagtaataaccttaaatgtaaacaaattaaatttctcacttaaaatatatagattggctaactggatttaaaaaagaaaaatgacccagctatatgccacctacaagaaactcatttcacctataaagacacatatagactgaagtgaaagaatgaaagaaaattattccatgcaaacagaaaacaaaagtgagcaggaattgctatatacttataaattaagtcaaaaggtgcaaaaagagacaaagaaggttattatataatgataaagggttcaatttagcaagggtatataacaattgtacatgtatccgcacccaacactggagcacccaggtatataaaacaaatattaataaatctaaagggagaaatggccttcaatacaataatagtgggggattcaacacctatagtcaacattggacaaataatctagacagaatatcaacaaagaagcattacatttaaactatgctttagatcaaatgaacctaacagatatttacagaacatttttatccaatagctgtagaatacacattgttctcgtcagcacatggaatattctctaggataaaccacgtattaagccacaaaacaagtttcaagaaatttaaaagaattgaaataatatcaagtatcttttctgaccacaatgaaataagactgaaaattaataaaaagaggaactttccaaattgtacaaatacttggaaattacgcccccccccccacctttttttgagacagggtttcactatgtcacccagcctggagtgtagtggcatgatcacaactcactgcagccttgatttcctgggctcaggcgattctcccacctcaacctcccaagtagctaggactacaggtgcacaccaccacacccagctagtttcttgcagtttttgtagagatggatttttgccatgttgccctggctggtctcaaactcctaggctcaagcaatccacccacctgagtctcccaaagcactgggattacaagcatgaaccattgaacctggccaacaccacatttttgaatgaccaatgagtcaatgaagaaattaaaaaaaaatttattgaaacaaatgaaaatagaagcacaacataccaaaacatgggatacagcaaaagaagtgctaagagggaagtttatagcaataaacacctacatgaaaagattagaaagatttcagattaaaaaaaaaacaatgcatctcaaggaactagaaaagcaggaacgaaccaaaccaaaattagtagaggaagagaaagaataaagataaaacagaaataaaggaatttgagactaaaaaaattacaaaagattaacaaaaggttgttttttttaaaaaagataagcaaagctgacaagctattagctagattaagaaaaaagtaaaaagaccaagtaaataaaataaaaaatgaaaagggagaaattacaactgataactcagaaataaaaaggaccattaaccactactacgaacaccatatgccaacaaattggaaaacctagcagatatggataaatttctggatgcatacctcctatcaagatggaaccaggaagaaatagaaaaccaaaacaaacaataatgagtaatgagattgaatcagtaataaaaaactctcatctaagaaaatcccaggtcctaaaatggcttcactgctgagttctatcaaacatttaaagaagaactgattctcaaaatcttccagaaaattaaagaggagggaattcttcattcatctgatggggccaccattaccctgatatcaaaactgacaaagatacaacaaaaaggaaaactgtaggccaatatccccattgaatagaaatgcaaaaatcctaggaaaccacatccatcagcacattaaaaagatcattcacatggtcaaggggaatgaatgcaaagataatgcaacatatgcaaaataaacatgatacatcacatcaatagaatgaagtaccaaaaactatatgatcatttcaatggatgcagaaaaaaatatttgacaaaattcaaaatcccttcataataaaacctctcaagaaactaggcatagaagagtatacctcaacacaataaaggccatatctgatgaactcacaactaaattatactgaatgggttcctctaagaacaaaaataagacaaggatgcccactctcctcactcttattgagcataatactggaagtccaagcagggcaatcaggcaagaaaagaaataaggggcatccaggctggtcatggtggctcatgcctgtaatctcagcactttggaggccaaggagggtggattgcttgagcttaggagttcaagactagcctgggcaacatgatgaaacccatctctactaaaaataaaaaaattaacttggcttgatggcacatgactgcagttccaactacttgggaagctgaggtgggaggactgcttgagcctgggagtttgagctacagtgagctgtgagcatgctattgcagtccagcctgggtgaaaaagtgagaccctgtctcaaaaaaaaaaaaaaaaaaaaaaagaccggcatccaaactggacaggaggaagtcaaatagttcttgtttgcagacatgatcttacatataggaaaacactaaaagctcaaccaaaaaactcttagaactaactgataaataaattaagttgcaggatatgaaattaatatatgaaaatttatagcctttctatacaacaacaaactagcagaaacagaaatcttgaaagcaatcccattttcaatagccagcaaaaattacctaggaagaaatttaatcaaggaaatgaaagatctctacaagccaatctataaaacactagtgaaggaaattgaagatattacaaaagtggaaagacattccatgttcatggattggaacaattaatactgtgaaaatgaccatactaccaaaagtcaatgcaatccctatcaaaataccacaggaattcttcacaaaaatagagaaaaatttaaaaaatttgtatggaaccacaaaagctccaaaaagccaaagaaattctgagcaaaaaaccaaagctggaggcatcacattaccgtattccaaaatatactacaaagctgtaacaaccaaaacagcatggtaccggcataaaaacagacacatagaccaatggaacagaatagagaactcagaaattaatccacatatctacagccaattgatttttgacaacaacaccaagaacactcattggggaaagatcagtgtctttaataagtggtgctgggaaaattggatatccatatacagaagactaaaactagactcccaactctaaccctatacaaaaatcagctcaaaatgtatcaaagacctaacggtaatacttaaaactgtaaaactcccagacaaaaacagaggaaacactccaggatgttgttctgggcaaagattttatggaaaagacttcaaaagcacaagcaacaaaagcaaaaatagacaaatggcactatatgaaactaaaaatcttctgcacagcaaaataaaaacaatcaacagagtgaagaaacaacccacagaatgggaggaaatatttgcaaactattcatttgacaagggattaatgtccagaatatccaaggaactgaaatattcaatagcagaaaaacaaataatctgatttacaaatgggcaaatgagctgaatagatccctttcaaaagaagacatacaaatgggcaacagatacatgagaaagtgctcaacatcactaataatcagggaaattcaaatcaaaaccacaatgagatatgttatcccagttagaatggctactataaaaaaggcaaatataacagatgctggtgaggatgtagagaaaggagaactcctacacactgttggtggaaatgtaaattagtacagctattatggaaaacagtatggagatttctcaaaaaactaaaaataaaactactatatgttccagcaattgcacagctggctatatatttaaaagaaaggatatcagtatattggaaagatatttgcacacccatatacgttgcagcactatttacaatagccaagatatggaatcaacctaatggctgaataaagaaaatgtggtagatagagacaatgaaatattattcagtcataaaaaagaatgaaatcatgtcatttgcagcaatacagaactggaggtcaataagttaaataaaataagccaggcacaggaggataatgaattgcatgttcacactcatgtgggagctaaagaagctgatttcatggaggtaggaggtataatgatgattaccggaagctcagaaggaggaatgaagagaggctggttaacggatattgaaatgggagatcacccttattctccttgcagggcgtgtgacagggttgtggctcacttctttggtgccctgctgcttaaacccctaggaagggcaatgcagacggggtgggtgcagaggtcgcagggagctcctttgggctctgacctcatggcagagtctggggtgagtgtttacgattctggaagcccaagtgggcatgtgttacagtgtgctccttcagcttcgctgtctgcagacagcttacgttaattggctcaattagaccctctgccttatcgcaagggcagagggttttctctaccctgagttcttgcccagtgtaccaggaacattggatcttggaggatgagtgcaaggttttatttatttatttatttatttatttatttatttatttatttatttatttattgagacggagtctcgctctgtcacccaggctggagtgcagtggcgtgatctcggctcactgcaagctccgcctctcgggttcacgccattctcctgcctcagcctcccaagtagctgggattacaggtgctcgctgccacgtccggctaattttttgtatttttagtagagacggggtttcactgctttccccaggctggtctctaactcctgagctcaggcaatccacccgcctcggcctcccaaaatgctaggattacaggcgtgagccaccgcgccggccgcaaggttttattgagtggtggaggtggctctcagcgagatgagtggggagctagagggggatggagtggaaggcagtcttcccctggagtcgcgctgcccagcagccggacttttctccgaccacccctggccgaattcccctcgatggctgcgtcgttccaccatcgctggtctgccagtatctgctggtgtctcctggttggtccctttgctcctcttgacgtccagcctctgtgtctgtgccagctaaagcctcgggtttttatgggcacaggatgggagagtggctggccagagtggtcttggaaaatggaacctttgggcgtgaaaacaggagtgcctgttctcacttaggcccgtgggcacaggcccgagggtgaagccctcaccagcgactccgctcttctgtacccagcacttccctgccctcctcccacatcagtattaaaatacagttagagtaaggagcagtagctcgagcctgtaatctcagctacttggcaggataaggtgagaagatagtttgagtccaggagtttatgacaagcctgggcaacataatgagaccccatctcttaaaaaaaattaaaaatacagtcaaatagaaggaacaggtttcagtgttcaatagcacagttgggtgaccatacttaaaaataatcttttgtatattttaaaatagctagcagagattaggaatgtacccaacacaaagaaatgattaatgtttggggtgatggatatcccagttaccctgatttgatcattacaagttgtatgcatgtatctgtgtcacatggaccccacaaatatgtataattattgtgcgtgaattaaaaatttcagtgcatgttgcaagtgaaatttttaaaccatgagtttttcagatgagtcatcctttcttgccttaagaccaacatcttattcttcagaggctctataattcactactatgccaagcctaaaaggactagtggatacttctatgacgtctatgcagatagtttaaaaaaagaagtgttccaatatacgtgaatcaatgcaactgtctccatgtataaaactttgcacatcactggtgagaatgaagggaagataattgatttggatcaatacatctacttcatccaacttcaagaagaactgttttgagtccagctccaaccaaatgcctccaccctaacttaatgcaggggcaagaaggcacttcttactttcctgaagttacagtgggttcaaatgacagaagttaaatacctactttgaaatctggaagatgtcactggagcttatgaatactctattgttgacttaaaaattatatgtgggctgagtgtggtggctcacagctgtaatcccagcactttgggagaatgaggtgggaggatcacttgaggccaggagtttgagaccagcctgggcaacacagcaagcccctgtctctaaaaaaaaaaaaaaaaaaaaaatttagcctggtgtggtggcacgggtccgtagtctcagctactctagaggctgagatgagaggattgcttgagttctggagatcaaggctgcagtaagcagtgattgcaccgctgcattccagcctgggtgacagaatgagaccatgtctcaaaaataatttttttttttttgcaaatacagtcacttgtatcactaagcaagtttcattttgctgcttctcagttattcaacaccctccccttttaattccaggctatccatctctagattagtcttctagtttcaaatgaatggaatcctacagcatgaactcttgtttctcgcttctttcatgcagcacatttttgtgacttaaacatattgtatcaatagctcattcttatctattgctgagtaatatcctattttctggatataccacagttccttatccgttcatcagttgacaaacatttgggttgtttccagttattggctactatgaataaatttgatattaacattcccctgcaagtcttcatgtggacgtatgttttcattcctgtcaagtaaatacctaggaatgtaatggttgggagttatgcaaggtgtgtatttaactttttatgaaactgccaaactgttttttccaaagtggctatatcattttacattttctttttctttcttttctttttttttttttttttgaaatggagttttgctcttgttgcacaggctagagtgcaatggcgcgatcttggctcactgcaacctcctccggggtttaagagattctcctgcctccacttccctaggagctgggattacaggtgcgtgccaccacgcccagcaaagttttgtatttttagtagagacagggtttcaccaccttggccaggccagtctcgaacttctgacctcagataatctgcccttcttggcctctcaaagtgctgggattacacgcatgagccaccgtgcctggcctcattttacattttcactagcagtgtatgtgagcttcccctgcaccacattctcaagtctttaacttgagtcatttcaagtatgtcagctgtaggtttatttgtttattactgttttagatgaactttaccagattgaggcatttcctttctattcccagttggcagatattttatgagaaacagaggttgaatcttctcaaatgtttttactgcatttattaagataatcatatggtttttcttttttagtctgttaatatgatgagttgcattgattgattttcaaatgtaaattcatcctgcattcctggcctatctgccatttggttatgatgaattgttctttttatatatttttgggtttgacttgctaaaattttgataaacattctttcatcaagcataacacatacaattatgtacagcacatactacttgataatgataataaatgactctgttactgattatttactatactaaaaataaaatatttttcagtcaggatcttgctctatcacccagtggggagtgcagtggcacaatcacaccagcctcaatctcctgggctcaagcaatcctcctgcctcagcctcccaagtagttgggactataggtgcatgccaccatgcccagctagttacacaatttttttgtggagataatggtctccctgtgttgcccaggctggtctcaaactcctgggctcaagtgatcctcccacctcggcctcccaaagtgctgggattacagacatgactgtgcttggctgaaaaaaaatttttttcataaatgttcacgaggtgtatgaggctgtagtactcttttcttataattctcccacccctctttttttttttagctttgggaacagtcaatgttgcactcttagaacaagtgggaaaatgttccctgcaggcctctattttggaacagcttgtgtggaattggtactatttcttcaagaaatgtttggtagaattaatcattgaagccatctgggcccaaagttttctttatgggaaggttttaaactaaaattgaattttataattagatatagggctctacagattttttgtatcttcttggatgaactttggtagtgttatggactgaatgtttgtgactcttcaaaattcatgttgaagccctaacccccagtgtagctgtatttggagatggggcctctatgaaagttaaataagatcctaagtgtgggaccctgatcctctaggattagtgcctttgtgtgcttgtaagaagagacaacacagaacattcccccatcctcccattgcaccactgaggaaaggccatgtgagaatgtagcgagagggtgactatccacaaggcaagaagagagccctcgccagaaaccaaatcagccagaaccatgatcttggactttcagcctccaggactatgaggaaatagatttctgttgtttatgccacccagtctatggtattttgttatggcagcccaagccgactaatataggcagctttcttttcaagaaatttgaacatttttaataaattgtcaaatatatcggcatagatagttcacaacattcttattatccatttaacgtcttttagagctgtcacttggcctctctcatttctgacatttaaaatttatgtattaagcactttttagtctagctagagatttatcaatttcattaatgttcttaagaattagcttttggcttctctcattttctgtttacatttcattggtttctctgctttttttaaaaaaccgtttcctcttttctattttatatttaacctgttttcttctggttttttaaggtggaagtttaagttattgaattgcttcttttacaatgtgtctaatgttataaatttcactcctaagctctgtcttagacacattccacaaatttagatatgtcacatttaaattttcaatcagttcaaaatattttctaattttggctgtgatttctcatttcatccgtgagttatttagaaatgtgtttagtttccaaatttgtaaagcttttccagaaatctttttaaaaaatggatttaattccattgagaccagaaaacatactttgtatgatttgaatcatttaaaatatcttgataggttattaatgtccaaactatggtttatcttagtaaatgtaccatgtacacatgaaaatattgtttgttttacatgaaatgttttataaatgtcagttgggcttagttcactattttcttccgagtagctgatttgctatttgttatacatgcatttttcatctatagaacttctacttggtatatatacataaaatctgacatgcctttcttcttcatgttcatgctttcctctacctttagaaaatgtacaattgcccatcaatatctgtgggttattggttccaggaccctgtggataccaaactccatggtgctgaagtcccttactaaaacggcatagtatttgcatataacctatgcatatcctcctgtttatcttaaatcatctctagactacttataatacttaatacaatgtaaatgctatgtaaatagttgttacactgtattgcctttaaaatttgtatttttaattgttgcattcttaagttccgggatacatgtccaaaacatgcgtatttgttatataggtatgcatgtgccatggtggtttgctgctcctatcaacccatcatctaggttttaagccctacatgcattaggtatttgtcctaaagctctccctccccttgccctcccccccgcaacaggccccagtgtgtgatgtcccctccctgtgttcatgtgtcctcattgttcaacttccactaatgagtgagaacatgtggtgtttggttttctgttcctgttagtttgctgaggatgatggcttccagttctatccatgtccctgcaaacgacatgatctcattctttttttatggctgcgtagtattctacagtgtatatgtaccacattttctttatccagtctgtcattggtgggcatttgagttattccatgtctttgctattgtaaatagtgctgcaataaacatacgtatgcatgtatctttgtagtagaatgatttatattcctttgagtatatactcagtaatgggattgctgggtcatatggtatttctggttctaggtcctatttttgtttcaaatattttttgatctgcagttggttgaatctacggatttggaacctccagatagaaagagccactgtgtagagtatattttagctgtgtcgttgactgctaactatattatctgtatgatttctgcagttttcactgacagatttttctccctgagtcaattttcctgcatgtttgcatgcctagcttttaagctgttaggcaagaccagaatagcctttatctagggataatttggctccactaatgatacatgcaataccttctgtttcctatgcctcaggtgttaggtctttctagtcaggctggtggaaatacaaactattcttgaccccgtttcatactgaaggattattctgctgctctattctagtggtttccaccactcttaggtcgtttcctcatgtgctgcactcgtcagtattcagctgaagacataagaagaaaccctgtgcggatctctggagctctttctcgcctgtgcagtgctctcctttctcctctctgccttgcaaattctggctgttttcgcctctgtaaattctgcctccttgatttagggaaactcctgggctttgtttgggtctgtcccctcacttcgacctacctcatgctgtttctgtgctgcaaacttggggaatcacagagcttaccttgttggtttcccttctttcatggcactgtcctttgctgtctgttgctatttgaaacccattggttcatgcattttgtctggtgttccaggttagaagtaaatccactttcttttcttcatcatgggcagaagtgtgagtcagacttcatttcttttcctttttttttttttttttttttttttttttgagatggagtttcgctcttgctgctcaggctggagagcaatggcacgatcagggctcactgcaacctccgcctcccgggttcaagcgattctcctgcctcagcctcccgagtagctgggattacaggcatgcaccaccatgcccggctaattttgtatttttagtagagatggggtttctgcatgttggtcaggctggtctcgaactcccgacctcaggtgatccacccgcctctgcctcccaaagtgctgggattacaggggtgagccaccatgcccagcccatttcttcattcttaaaacatagttttgctaagtctatacagatgacccttgaacaacttggggatttgggcatcaactccttgcacatttgaaaatccttgtataacttttgacttgctcccaaattttactaatagcctgctgttgactggaagccttagtcaattaacacatattctgtatgcttgctatatactgtattcttaaagtaagctggagaaaagaaaatgttattaataaaatcaggccaggcactgtggctcatgcctataatcccaacactttgggagcaggaggactgcttgaggccaggagttcaagactagcctggacaacacagcaaaaccccatctctaataaaaaaatcagctggcgtggtggcacgtgcttatagttctagatactcaggagggtgaggaggcttgcttgagctcaggaatttgaggctgaagtgagctataattatgtgccactgcactccagcctgagcaagagagtgagaccctgtctctaaaaaaagaaaaagaaaatcagaaggaagagtaaatatatttgctattcatgaggtggaagtggatcattataaaagtctttgtccctgtcatcaggttgagtaggctgaggaggaggaggaaggggagagattggtcttacttttcgggggtgacagagaccgaagaaaatccacaaagtggacccacaagctgggctcatgcctctaatcccaactactcaggaggctgaggtgggaggatcacttgaggacaggagttcaagaccagcctgggcaacacagcgagattgactccaaaaagaaaaaaaaaagtggaaccatgcagctcaaatccatatcattcaagggtcaattgtaagcctggaacaattattttctatccattggaggtatcattccactgcttcattactactgttgagaagccagctgtcagtcttgggcattttcttgaagacagtataactttcaatccttggcttattttaagatttttttcattgatttcccagttgcacttgagagactagttgcatatttcttttactttattctgcttgaaattcactgggcttcttcagtctgtggattgatgtcttcaattgttctcaaaagctctcagcctttatttcctcaaataactttacctcgttctctgtctctggaactctagtcaaatactcattacaacttctcactgaatctttgtctcttctcttctgtactgtttttctctcttggtgctatgctatgggtaattttttctagttctctcttctgccatgaagtttgctgctaagaatgtccactgagttttaaaattttggttattgtatttttcatgtatataaattatattttatctttgaatttgtatccctttttagtttctttccctacaaatattttcaagttcactgatcattttttaaacacaataagcatagttgtttaataatatatctcataattctatatctaaagcatgtgcagagcttgatttcttgtgcactattttatttttcaccccatgtccatcattcctcctgaaaatttatttacagtgctttgcaaaacacctaattaatgtgtcttccttcagagaggtactggaatggcttctgccaggttcagggggacactagtggttgggaactactcaaattatgtgaaatctaaaggtccttcgttcacccaggcttttgtgctcaaggcatacacacacagaaaaaaaccatctgaaggctgatatgtggccacaacttatctggcttttctgtccctttcccttcttacagtccctaatttggggttgggtttagttttagctctcccttagtgtgaagatgtaactctttggggtttcctatgggattctccaattaggatggtccttgaccttacctttcatcctttttgccccatgagcccactatatcaaagtgtgaggtattggacatgctttcaggtcaaaagtggctttttcccctacaatattctacttatttctctgagttgggccttcttcaaagctttggtcttgcaattcatcatctttttacctcttgtgcatgtttttaggtgtataacaaacacacacacactcttcaaagatccatcatcaatcaagtgataagcattagaatatgtgttaatttacggggaaaaaccccgactttaacctctctgctgagaagttttaaaatggtaagtagaatggtgtgttattcccagaataggaaatatcagtatatatattctttaagtgatggaatcttgctctgttgcccaggcaggagagcagtggcatgaccatagctcactgtagccttgaactcgtgggctcaagaaatcctcctgcttcagcctgccaagtacctgggactacaggtgcacaccactgcgtccagctaattttgtttttttgtagaggtgaggtctcactaagttgcccaggctggtcttatactcctggcttcaagtgatcctcccacctctgcctcccaacgtgctgggattacaggtgtgagccagtgtgcctggcctgtagaattcttaatgcattaatgccaggtgtactattttctatcaaaaaaatttttttttgagacagagtctcactctgtcgcccaggctggagtgcagtggcacaatgttggctcactgcaacctccacctcctggattcaagcaattctctgcctcagcctcctgagtagctgggattacaggtccccagtaccacgcccagctaatttttgtatttttagtagagatggggtttcaccatcttggccaggctggtcttgaactcctgacctcatgattcacctgcctcggcctcccaaattcctatcaaatttattctttttggttctctgggggagataagaatgtgcaactaataacagtgtaagacctagaaactgctctgaccctgaccctttacacaagtgacttaatttcatgttcaatatccttgcatgttaaatgcagaaaagacaaagttatcctgatagcccatttaatgctaacatttattaatctacagatgcttccacatgtcaattccaacacttataatagaccttactgaaaaatagcccttttcctcactggcataatctttccataacaacactccagagtcacacactgctaatcgactggagatggcacaaatcttattgatcatccttattcctgcacatatataacatcttttgaaatatggctaaaacaatttttttctaccatattatacccttttctaatagttgtaatagtttaagaattaatacacaacctccccaaaatcatgcccatctttcaggattgtaaagaattaaaatattgaattcattttcttccattatgaagaaagaaatcatcaggtacaaaaccaacaaaagtattatcagcttgatgtaaaagccttctattgagaaaagtaaaataataaataaaagacaattgatatacttcaggtagataataaaaatttaatagcaatatcataaaataaacacacatattaaaaaatcaagtatttagtttcggatattagaaataatatacataataaattcaacatactgatagtgctgcaagataagattttatttttcaaattacatattatgccaaccagcctgctttggactcagaggttcaaaaactttgcttttattacgaagaacatctggactgtagacacctctaacgaaaccaggttatacttggcatattgtgattgaagctgtgtgatcaacatcttaatgacctaactaaatcctctcataacagaaagaagttcaacaggcaaacatttccctccctaggatcctagttaccaaaactgtcacagtgtcaaaataaaaataattatttcctcctttttaacatcttattgtccttgaagcttatgtatggaggaagttaaaaaccaaaagagcaactttaagctatatgctaagtcagtgttaaatccacagactaatttttcgatatagtattcctggttctggtccttaaagagaaataaaggcattaaaccaactttttatatgtcaagaaatataattttgctattctttcataatcaaatctttcaatgatttctaagactgtttctacagcctgtgtgctagttcaggagacacactgattgtaaaaggacttgagaatataaactttaaggctaaaaatttcatcttcaaaatgtatagatgtaaacagagcccttgacaaggtgatttaatgtagaactgctggccagaatgaaaacaagtactagacagaaaaaagatcatgcttaaagactccattgaaaaaccacagacaggtccttcatgacataggtaattccttcaacctaaagacatttgctgaaactcaaagttaccctattgcatagtaaatcttcaaaaccattaagtcaggttctgggtcaatgtttcctatgctttggttggatgatttaataaagtatatattttatgagatttaaccatggaattcaatgaacaaaatagataaaatattagaatcttcactgaaaaatggcatgtttctccatctttttcatgcaataagaaagtccatcttaaatctgattttttaaataaataattgctgtatttcccactgaagcttgttattctgataagccaaattcaaatgctttcatatagttgaggattaaaaaacattttgaggattattcatcattatctgtagaaaaaagaaaaaaattgacttcatttcaaatcaagctgtatctactttaaaaaaaacccattcttgttcatgctaaaggagaagagctttaatgtagttttaaacatacttttaaaattattttatcacacattccttgtaaaatattcagacaatacaatgaagaataaaatgggaagcaaaaatcatctgtaagtgaaagacaaccaatgttaactttatataaatcctcccacaatgctttcctatgcatacacaaatatcttttaaaaattacactaaaatgcagttttgaaacataggttttccactgaaaacaccctagtgaatggaaaggtggatacataagtgataatgtaagattagaaaatgctaatgttagaatctaggtggtgggtgcatgggtgatcactgtaaagttctttcagattttcaatatgataaaaatttgacaataaaatgttaaagaataaatcatggatatattctatgttgacttcaatgtctgcagagtattctgtttaatggatatgacataactaaccattactatttatagacatttttgttattttcaatttttttaattctaaagattataatcaagtgaattaaacagactggttaacttaatcttatatgcaagcactatcttccacattctagcaaaagtgatctttcattaaaatccaagggtcatgtcaaatcactgcactgcttaaaacatttgttagctccctgctgcctcaaaatggaatccacgctccttaacgtggattacaaagcccttcatgatctggccttttaaatatttctcatcttaccaaatttcattccccaccttccttaactgcccctataatttatgctttaggaacactgaattgcttatagtttccctactacattttgcatacttccatgtatgagtacttatttgcattaaattcccatttgtctttcagaatccaactttgatgtcctctcccctaggaagacctatcctgtcaccatcaatgtagttggatcattactttataacttacatacattttattgcttccaaggtaacacttatcactggactataatttacttacttttcaaataatcaggaaagtaatgaacacacatatccataatatgtagaattaacaaaagctaacttttggccatagtggtttggattatttaagtaaaaccatattacagatgcagagtaccctttctcaatcttactgccttcctttcttccccaggggcattttcagtactctgaaattgatgtgtattcttcccgctcatggtttttgcttttatttttattacgtacatgcacatctaaataaaattgtttagaaacactacataaatggtgtaatattctacttattcaactcatcatgtttgtggggcttatccatattgacagtcggaatttaattcattcattttagccgatgtatacaatttcattacataaacgcagcccaatattccacctaaaatgaatatgaagagaaggtatgtgtctctttcttaagagtctataatggccaggcatagtggctcatgcctgtaatcccagcactttgggagaccgaggcagacagatcacctgaggtcaggagtttgagaccagcctggccaacatggtgaaaccctgtctctactaaaaatacaaaaattagctgggtgtggtggcacatgcctgtaatgccagctacttgggagggtgagacaggagaattgcttgaacctgggaggcagaggttgcagtgagccgagatcatgtcactgtactccagcctgggcgacagagcaagactccatctcaaaaaaaaaaaaaaaaaaaaaaaaaaaaaaagaagaatctataaacttgggccgctaatgctaatactcaatgtgagaacatggtagcctctgccaggttgccactggccacagctgttatactcctctccttgtggaagaatttattaggaatactatcaaatcgcttacacattttattagctctatttgacttctgactctggatagtatctagctatggaaaaaaaagcattaactttatcaacggctgaagatattgacgcttaccaaacctgcaccataacagtatcaggagagttaaatagctgaggctgtcttttcaggacttatataatttccagtgaaataaaacagaaatgtgtttttgacaatcttctttttaacttgtatcttaatgacttgatgtcactttcgggtgagcgagataaaattttgcttaccccttcccttctttactctcccttttccccaacacagaaaataaaagtgtgtaagtaccatatgtagatgacatggctttaccatctcctagatgtggcctaaaagatagctgtctggacaactatctctaagacaggtaggctgggtgcggtgggtcacacctgtaatcctaacactttgggaagctgaggtgggaggacagcttcaggccaggagtttgagatcaacatggcgaaatgccatctctgccaaaaaaatacaaaaatgagtcaggcatggtagctcacgccagtagtaccagttactcaggaggctgaagtgggaggactgcttgagcccaggaggcggaggttgcagtgagttgagatcatgccactgcactccaacctgggtgacagagcaaggccctgtctccatagaaaaaaaaaaatcccaacaaaaaactccccaaatcaaaaagaacagctatatatgggctctactgacttccaataagaaggagtgcaaaacggttattctgaatcaatgaatatgaaatctatatctagtcatttcatttaactctcatgattaacaatacaaaacagcaagtcatccacataattcaatatccattttataaccagtttctttagtagctatagtagcaagttacaatattttatgggctgtactcaatttttttttaagctacacctgctgtaatggtatgtactaagagttttagaaaagattgccagggtaggcatcttcaattgctttacattttttctagggtgaaggaattactgtcaggctttatgatacagaactctggggttctctttccctttccatttgtgtactagagaaaatctgatattgcttcctgagtggtgtattaacctagcctgattcttggtcctttgcaggggaaatggccttctgtgtaggcttatatccttttgaagccactcagttgtcaaaagagggtgtcaattctaccttgtgaataagttgattgttacagctctccacttaaggggcaaggcaaactaaaagctctccagatacttgttgagcaaaactgaaccccaagcacattgttgctgattacttatgaaaagctctattgaaacaatacttaaggagaaccgcctggaggtggaatagtctgaatatgaatagaattggtttgatacactctacagaattactgaaatggaatcatcctctggcttcgtgccattaacttacagcatgacatatgagaaacagcctcatgaaatctaaatattgtaaaaattactgaggatacttttcattccattatagcactgttttgtaaaatgaagtccaaggtctcaataaaataagaaatccacaagtaccagaaaatgtttaccttttatattttcattttgataaaattttttaatatttagaaaaatacaacatgttttacagtaataattcacaactaacagaaattttctaccactaagacttgagtttttttttttttactggggtttatagacccttggattctcatgcctgaaaaaaatactttttgctccttaaagggatccacatgttattcaagtttgaggaacactgtatgatagtgccctctttttaaagatcatgggaaaattgttcctttggtttcaataccaaaaatagctgtcctctgagcaactaaaatgttttgtctcatgaatactgtgactcatgtaattaattaggttttctgctttgtgagaaagaccagcaccaaatttgtttcctgtttttagaaaatgtggaaaccttttgaacatgaagtttgtattcttcattcctggcttcatgttatactgcttgtgctcatttgtccaatttgttgacttccccaaacttttttttaaaacttaattttctctcttactatatacatatatatatttcaatgcaatcttagacttttttgtatgaatatgcaaacacattttgtatggaatacaaatacattttataaacatttttattgctaaaattaagcatcaacatttaaaaccctcaattttagtctatgaatttaacatttaaagtaataaaattaatgtttgggcaaataatctagaaataaattcttgttcaaaattttacatattgctttttgtgtctacaagttttgccaggtgcagtggctcacacctgtaatcccagcactttgggaggccaaggaggggtgaatcatttgaggtcaggagttcgaggccagcctggccaacatggtgagaccccatctctactaaaaatacaaaaattggccaggcatggtagcacctgtaggccaagctactcaggaggctgaggcaggagaatcacttgaacccaggaggcagaggttgcagtgagctgagactgtgccactgcactctagcctggacaacagagcaagactccatctcacacacacaaaaaacgtttaataccacatccttgataagaactattctagggccaggcgcagtggctcacatttgtaatcccagcactttgggaggctgaggtgtgtggatcatctgagatcaggagttcaagaccagcctggccaacatggtgaaaccctgtctctactaaaaatacaaaaagtagtcaggtgtggtggcgcacgcctataatcccagctatttgggaggctgaggcaggagaatcacttgagcccagggggtggaggttgcaatgagccgagatcacgacactgcactccagcctgggcaataagactctgtctcaaaaaaaacaaaaaaaaatgaattattctaagttataatcttctttatttttatttatttacttttttgagacagggtctggctttgtcaccaaggctgagtgcagtagcacaatcacagctcactgcagcttcaaactcctgggctcaagcaatcctcccacctcagtcccctgagtagctgggactagaggtgcccaccactatgcctagctaattaaaaatttttttgtgtgtagagatagggtttcactatgttgtccaggctggtctcaaactcctggcctcaagccatcctcccacttaagcctcccaagtagctggaatcacaagcataaaccacggcacccggctaggattattctaattgctagagctgtccaaaaatctatctagtaagatttttaaaaacctcattcaaaggttacttgtaaattaaattaaaaatatggacttaaaggacttaagtcagtaaaagtatatgacagatcagtaaaagtacatgacaaagttaattttattattgcttaaaagttatatagttcccaagtagatttcacaaaatggatgtgatgtaagctgattcatatacatgtatcatcttgtttttctcacatttactgaaaattatacagacatgtgaggaaatcttaccttcttggtaggctccatctgccatgactaaatgaagaatcttggcataaagatgctgatgttcatttcccaaaatattttgaactatttttgaacaaatttcaatattttcatcttcatcttcatgaatagcctataccaaattcccaaatataaattaatatttgaataactttctgtaattgcagacttcactttttatttataataaatctaatgaccaatacagattatcaacatttcttcaaccttcaaacatagcacattttaagtgttttaattgacttttcacttacctttattttctcataaacctcaaagaatttttcaaagcccatttcctgctccagatgaagtctcagttcctctaaatggttaaagacactatcgcattcacattcactagcaatttcaccatcactgttatctaaaaaacaaaattaaaatagagatttgatttaaaaagactgaataactcataccctaatagactaaaattctatgacaaatgaataatgccattgaaatagactacttctactttcattataaacagtttttgtcattttaatatttgtcctttatttggcaaaaaaaatgtataaatctgtctaaacaagaatgttacttttcatgtatagatataaaaaataaatcaggttggaatcaaaacactcctagagatgttacttaaataaaaaaaaaaaagtggaaaaagcacacctccatgttttgctttgaagcagctaaccctaactagtattttcaaaagttggtaataaacacgggaaacaccatggaaaagcctgcaaaaggtagacaacctaagacatacatcattacatttcaggaaagcacctagaaagtataaatggccaatatgttttgtcatgtacgtgctcgacatactttgaaaaaaattacttagtcttttcacattagcttttcttcctaaattaatatcatatagttattgaaacagacacactttctatgcatcttaggggtaatattatgaaagagaaagtttacaaatttacgaaaagagtttttagtactttaaaaactgctttcagtgttaactctgctggttaatatatgcagaagctctttctaaaatatagaatgccaagaaaacaatgttattatctttattactggaaaaatcagtcaataaatggagattagaataaaaatgcttcaaaaaagcattgacataataggaaagaaataaaaactttaataaaaaatggaaaatcacacatttgtatgaaaagaaaaagaatgaaaaaaggggagagacccagaggcatgcttcagttgtatttaaagttggaaatggttcacagcagagattagaaaaatacactctacttgaaatatttgtaaactgaaaaagaaaaaggtccaaaactctgatcatgcacctgagtgccattcttcgttcagggcactttcactgctgggattgtcatcttcatctgccacatctgtcccatttgcagttggctccacatcactgttcttcaagactgactcttcttcttcactgtattcttcaccaggttgttccctaagtaactgttccatcgaggcctgcagctcttgtaaatctgtgtcagtttcttcaaacacactgaaatttaaaaagtataactaaaagtttcaaacatactgaaatttaccaagttaaacaactaaaactacctcatactgaaattttacttctactcaatacgtaggcacttcttaaaaaatcctaatagtagataacaaaaaatctggaaaaagcctacattgtttttcaccggtaaattgaggatgaatacaactgataaatatatcacacaacacatattctggaatatataagccagaagatgatttgtttaaaatgatcccaacttgccaaagagaatcacataactatcgatgttactcattgcttaaattctgaaacaatgttttgatattttaacaggccagactatagaagtttttctaaaacaaataatagtaaattattttctcttttatggaattttgtaattttcaaaatatccatgtggctaatagctagacactatacaaaaggctttccatatacatgcccattgggcatttgaacttttagaaatagaaatacttaggaaattttatattcatgttaataggatgacccagtgaataaaatggtcaccagaaatcttatctttagatgcttattcttaaaaatgttctaaaatacataatagattttctgtgtaactagcctataccaaccatcataattcttcactggagaattttgtttccaaagtattggtaagaatattcattctattttcatgggattatagatgctggaatgaaataacttatacaaataataccttacatttatatagaacttttgttttttaaacatttttatcctactactcaaattttatccacaaaaaatcactttagagacatgaaaactatgaaccaaaatgtttaaatgacttggtcaaggccacatagtcagtaaatgacagagcactgaaatctagtctttgaccacttctgtaatatctgagaaacatactcagaaaaatttttttcctcttatgatttgcttctttatcctaacatggaatgtaaatggaaaagtttgtagactaaaggagttaactgatgttttagatgtctgaagacttctaaaagagattatgtacctaagccgggatttcatctatcaggaaggcaatgcttaacaggacacaagggctaattaaggcctttctaaaagtttagactccaatcaaatatttactgaagaactaaaatataaacactattgtgtaagactgtcaatataatttccattaatagagtaaataatctttttatgtagaaatatctttattttgtacttatatgtacaaacgcctacaatttgacttgtaggagctatagaaaagcaaagcatctaattagaatgagaaaatagtgtctaatctcttgaatcatcctactagtagcatttaacttaatatataattacaagactaatttaggctgggtacagtggctcatgcctgtaatcctagccctttgggaggctgagacaagaggattgcttgaggccaggagtttgagacaagcctgggcaacatagcgagacccctctagaaaaaaaattgcaaaaaacttagctaggcgtggtggcacgagcctgtattcctagctactagggagtctgaggcaggaggactgcttgagcccaggagtccaaggctgctgtgaactatgattgcagcactgtactatagccagggtgacagagtgagaccctatctcccccaaaaaattttattattaaaaaaagatcaacgaagtatgcacacctgctatgtaccattactacaatgagtaaatattgacctgttcataaaatcatctagtggctggcctagaggaattagtaccctctgcagatggtattcaattgaggcagctaagcttgccactgtaagaaagtatgagaagattaagatcttttactaaatgagcaccaaaaaactttaaggtacttaaaaaaatttggtcttgaattcagtttttagttggctatcttataaaatcttgactaaagtttagacaaaaaaaaataataataattttccaaagacaaacatcaagtgaaatatccctataacaatatgaaataacgtactttaaaaacaacttggttttcgaatttttcaattaatactaaaggcttctaacttaagttttaaaataaaattctgtcatcaattgttcattaaaagaacacatgcataacacaaacttagcagcttggaagaaagaaaaaataaaagaacacaagccacaaataagctgtagttcattcagataaaaataaatgatttcataaaatttttgggaaaaaaattttagttagcagtttgtcaacaataaaaatcctgaatgttgttatgttctccaataggattaataaaaacacaatatttcagtgtttaatgactacagtcaagtagaagaaacaaaagtaaaaaggtaacttttcttctagattgtaaggtcattagcaaaaatctacagaactctaggaaaaatgaaaaaggcaatcttttaaaaatgaagtttcaccagaaacttaagaagcaagggcaaggcttaaaaaagaaccaaaaaccagaaaataaaatgtgccagcggcatcgatcctacgtaactcaatacagaagaaaacattatgagagtgatataatactttcaatcagatcaaaatacaagttctttccaaaggtaaaagtaaaaagcagaaacaagttcaaagaaattacaaaataaattataaaaattctaatattttataactttttatccaggtgatttgaacacactgtaccttctcaccttactctaggaaactctggttttattacaccaaaaagtgtgtaacatttgtctaagacagttgagagggctgaccaacactgaacaaggtaaaggaaggttctttttgtttttttatggaaaaaaattttttttttaattttactttaagttttagggtacatgtgcacaatctaaggggttatcactccttacagctctcagaggtattgcttgttaaatttccctcctagattcaggattccccatgaatcacaaagaaagcaattttgtgaaaacaatccaattacatgcagaaaacatgtgtgcactgacacatgtgcacacacacacatgaacaaaactggtcgacctgctaactccccattggcatggctttgaaatcatatatggcaagaggtagatgtggagctttctggtcattctcctgggaaactgtagagcacagtcatgaattgcttaacaacaggaagcattctgagaaatgcattgttatagccaatttcattgttgtgctaacatcatagaatgtgcttacacaaacctagtcagtatagctaactacatacctaggctacaaagtagagcctgtttactcctaagctacaaacctgtacagcatatgactgtactcagtactggaagcaactgtaacacaatgctatctgtctattctaaatatatctaaacatagaaaaggtacagtgaaaacactgtataaaagataaaaaatggtaaactttatagggtacttatcataggacattactatacactactatagacttataaacacagtatatgcttaggctacactaaatttatcaatttatttttctgcaataataaattaacttggccagtcccagtggctcacacctgtaatcctagctatttgggagagtgaagtggaaagattgcttgagtccaggagttggaggctgcagtgagctatcatcatgccagtgcactccagcttatttatttttcatttttgagacagggtctcactctgttgctcaggctggagtgcagtggcatgatcatggctcactgctgcctcaaactcttgggctcaaatgatttttccacctcagcctcctgagtagctgagactacctacaaggcatgtggaaacaaacctggctattaaaaaaattttttttggctaggtgtggtagctcatgcccgtaatcctagcactttgggagcccaaggtgggcagatcgcttgaggtcaggagtttgagaccagcctgaccaacatgctgaaaccccatctctaccaaaaatacaaaaattagccaggcgtggtggcaagtaatctcagctactcaggaggctgaggaggagaatcgcttgaacttgggaggcagaggtcgccgtgagccaagatcatgccactgcactccagcctgggtgacagagcaagagtccacctcaaaagaaaaaataaatttttttttgtagagatggtgtctcactatgttgcccaggctggtctcacattcctcctgccttggcctcccaatgtggtgggattgtaggtgtgagccactgtgtccaacccacactccagctaggtgatagagtgacaccctgtctcttaaaatagataaaaataatatacagaagacataaaagcagaggttaatgattaaaaaaaagagctaggtaagttatcccctcttttttacatataaattcagaaactcttttaatgctgtttactaatgacattatagccactgtgtccagcctgtattccagctaggtgacagagtgagaccctgtctcttaaaatagataaaaataatatacagaagacataaaagcagaggttaatgagttaaaaaaaagagctaggtaagttatcccctcttttttacatataaattcagaaaatcttttaatgctgtttactaatgacattatacttacatgtcttcagaatcagaaggtccttctttaatgttttcatcttcaatttcatctatttcaagattgtcttgacgaacatctcctacggtgggaacatccataagggttctgaacagctttgagagatctggaagtgaacatgtccttaacatctaaaataaaaatcaacaaatttcttattaggagaaagataattaaaacataaaaatgagagaaaactagaactaatcacaattttgttacatatgtgtaaaatgtaacatataaaaagtttttttatatatgtaacatatatatgtaacatataaaaaatatatatatatatttttagagctagaggatccaaaggtgacttgcataaagctagaacctaattctcttgaatttcagctcagtcttttttcacaggaaactaaacttgtgagttatgtttgggttttagcacaggaattccctgataccacctttgaaaactgggagaagtgtttatttaggtataaacatggaatggacttggaaatctgtcaggaatcaggcagtgctagaaactatctgttttctccttctcactcacgacccatttgttccgctttcacggtgtttctgctaagtgttcctctcatcttcctatggtcaacttgccccacacagtcttgcccaaatgctgcagcatgttagtctgaagtttggctaagcaccaccacacataactgacagccccttgtatcactcaattgtaggaactgctgattagccacatactggtgaaatgaggggcctcaaatcagtgcagagagaagcctatcagtgcttccctgaccatgggactgtgagtggaacctttctcactagaacagaaggcaggaaggacaagcactttgatgtcaatgctgagcataatttgcaggaacagtaagaagaaactcagccaactgagttgaggaaagaaaaaaagcacagctgaggtgttgaaaatgtgaatccgtactggataagggataatagaaatagcctctgtccaacaacctttcaacaattagaatgtgatagatagacaaggctatgaaacaactaactacatacataactctcacagctgggttaaccctaaaggaatctgtgagatttgaaacatgactactaaggcactgataagaactcttcaccagatgggagcctgtgaggaaaacacaatgtttagcatattaatgaaaacttatatacttggccaattttattggtacaatctgtttttgagaataatgaaaaagatttccattatttgaacataatttaaatgttctcacactcaagggaaaaatcgttatgaactacaagttggtaaaagtacactgcttgttaaatcacttagtgatggtactggaagtatttcttttgctgaatttcccactgtctgtagaattcacactttccttgtttattattttaatggtttggaccatgtatattataaactagcaatatgtaccagaaatggtttccttaggtacctgctaatcaataaacagcacatatgcattatataattaaatttggggttactacataaaataatgcaatattttttaggctgagataaattctggccctggtaaaataaactcaattctagtttactccttttgttaaccaaaataaatttcaagtggtcatgtaatttgacaacttacctcctggaacaggtttataccaacccactaatctgacagctatcaactggataagcccttcatgttcacagtactccttgatagactagtaagtccccccacctactcccccatggctttggaggcttttttccctatagatttatttattctcatttttccttttcatattttaaacaatacaaatgattttttttatttcaatagtttttgaggtaaaggtgatttttggttacatggatacgttcttcagtggtgatttctgatattggtgcacgcaacacccgagcagtgtacactgtacccaacgtgcagtcttttatccctcatctacctctcacccttccccccttgagtcgccgaagtccattacatcactcttatgcctttgggtcttcacagcttagctcccacttatcaatgagaacatacgctatttggttttctatttctgagttacttcacttagaataatggcctccagctccatccaagttgctgcaaaagacattatttcattcctttttatggctgagtagtcttccaaggtacgtatattccacgttttctttattcactcgttggttgatgggcagttaggtcgtttccatatctttgcaattgcaaattgtgctgctataaacatgggtgtgtgtgtgtctttttcatataatgacttcttttcctttgggtagatacccagtggtgggattgctggatcgaatggtagttctacctttagctctttaaggaaactccatactgtgttccatagtggttgtactaatttacattcccactagcagtgtaaaagtgttcccttttcaccacatccaagccaacatctattgttttacttattgtttttcttttttttgagacagagtcttgctctgtccccaggctggagtgcagtggcgcgatctcggctcactgcaagctccgcctcccgggttcacgccattctcttgcctcagcctcctgagtagctgggactacaggcgccctacaccacgcccagctaattttttgtatttttagtagagacggggtttcaccatgttagccaggatggtctcgatctcctgacctcatgatctgcccgtcttggcctcccaaagtgctgggattacaggcgtgagccaccgcgcccggccacttacctgtttttggacttcttaattatggccattcttggccgggtgcagtggctcactcacacctgcaatcccagcactttgggaggccgaggcagatggatcacttgaggtcaggagtttgagactaccctggctaacatggtgaaactctgtctctattaaaaacacaaaaatctgccagtgtggtggcatgcgcctgtaatcccagctacttgggaggctgaggcaggagaattgcttaaacctaggaggcggaggttgtagtgagccgagatcacaccactgcactccagcctgggcgacagagcgagactttgtctcaaaaaataaagaaaagaaaagaaaaaattacggccgttcttgcaggtgtaaggtggtatctcattgtggctttaatatgcatttccctgatgattagtgatgttgagcagtttttcatatgtttcttgtttatattcttttcagaaatgtctattaatgccctttgctcactttttgatgggattgtttttttcttatttgtttgagttcctggtagattctgaatagtagactggtaagtttgaaacaggttattcatctttggtcaagagaattttataaaagaacactttcagttctataattctgattctactatttctatgttgtttaaacaatattctatagttttaatatccacaaaaagaactctttctgaaaataacagctcatctataacacactggctgagatcttcatgtacagtattttttttttcaagattgttacatgataatttacacatctagcatttggtaccattataagttcaaacaggagtaccaaattttaggaaaccttaaaatgtttccttcagtttttattgctggttagttctattttttttcaaagatgtagagaaacatataacatagtgaatgaattcagtattacttgcattaacagaacttcaactaaaaaattctactcatagtaattctaatacactctttgagctccagtatttttcatataaaatcaggaagtagtagtattctagttacactaccaaatgtcttatgatggacacattcttttagcctctgtttactgcaattaaatgctgctgctgctctctaagaataaccactgtgaatatctgcttacttcaaccgatacatcaggctcaaaatggatttaaaacattaatttaaaacttaggaacacttcccaaagacaaaaattacggacattatctaataatggaatactttaacaaatcaaaagacatctaaggtacatgtgctatttatgtgaattatacattcatcattttttgccactttgcatttgctttaacaagaaattctcaagttttcataaagcagatcatttttttgtcccactccctatccacagaacacatctggtctctctccatcccttattcactatcccctaaagtgaagaaacacgagctgactgaaggcaaatttgcaagagggcactgacagtaaagtgtgtgtccttcctgttctctttctcagatctgcctgccacagagtgtgtgcgtgcgtatcctgtttcccttctgttgccttgtggtgagcacaaatagctcaggcctacgcctgctttctagggacaagataggtctcactctcagtcttcctgctactggagcttgatggatataaagctcttattgtgggttaagaaagtttgttcttcagattccaaggactagtcacaggaggaaaatattgagaggcatgattttaagccaaacctaaggccacattttccagtagagctttatcaaaaataaaactgatattatgatctttatctgactctattttttttttttttttagtctcagtggtcatgactgactgacttatattttatttttgagatggtgtctcgctcttgctgcccaggctggagtgcaatgatgcaatctcggctcactgcagcctctgcctcctgggttcaagcgactttcgggcctcagcctccagagtagctgggattacaggcatgtgccgccacacctggctaattttgtatttttagtagagatggggtttcaccatgttggccaggctggtctcaaactcctgacctcaggtgttccacctgcctcggcctcccacagtgctgagattacaggcgtgagtcactgcacaccgccatgactgacttttatgtcattttaactggctgcaaatgaagtggagttagcaggtaattctctatctcaacctacttcagatttcatgggattataaattaatcaaatcttgaaaatgttactatttttaaaaattccattggaaaaatatattgataatttccctttataaaatcacaacaaatgcaaagttttgatttgaatctttacaaacctatgttggcctacagaccattcactgcattatgaaggcatgtatcccagccaggagtaacctctgaggaataccttcatacctgactagcaggctccagataaggaggagaaatggggctcatgtacacaaactttcttcactagccttgcttcaatttttccaattatttatgatcatgtattttatcatttatattctccaattagaatggctccatgagcagaggatttttgtctgttttcctcactactgttaactctagcatttagagtggtacctggcacatagcagatatttaataaatatttgttgactaaatgaatctgccttacaatagcttgactcagagtgagaatttgtgggcaactccacaaattcatcctgtatccacttgtgaggacaaccaaacaggcttaaccagtttgtacttttaaagaaacagttgttctttagagaagaatacaagactgtatcactggctttaaactgcttatcacctgtcctacctttgtttcttctgaaggtggaacagtgtttccctagactgatttctacttttaaaagcctccttgtaaaaggcttttaatcaaaacccatcactgatgaattctccctaacaggacaaagaaaaggaaagctttatggtagagaatgaactttaaaccatgcttcaccattatcttctactattggacttctttggcctgcctatacctttatcaaaacaaagctagatttggtaaggtacaaagcaaccacatgtaaaaagtccctaactgatgaatacattctatccactgatagaatttattgggcattaaccatgtattagatgctgaggatataatggtgattgaaaatagatccagtctttgccttatgatacttttagggaagaaaaatatcctgactctgggaattctgaacatagaaaagttatcaccacaagactagagaacagttgtggcaacagaaaggagaaaggcttatctacgtttcaggagccataggtctctgctggaataagactgagaggggtggtggggggagggagggaggaagagagaggaagaaagagagggaaagagggaggcaaggagagaggcaagggagattgagattgaatgtctctttgatggagttcacttaatgaacaaatataaggacccaaacttttcagactgttctgatttgtgggctataaactctaccttctgttcacttaacatcataggtgtgtggtgttaatttagtttatgtcactttttttttaaagcaactctttactccttcaaactatagttattaatatttaaatagtacagctaattttttttttttttgagacagggtcacgctctgtcatccaggctggagcgtgacggcatgaacacggcttactgcagccttgacttcctgggctcaagcgatcctcccatctctgcctccgaagcagctgggactagaggtgggtgtgtgccaccatgcttggctaattttaaaatgtttttgtagaggtgggggctaactatgttgctcaggctgctctcaaactcctgggttcaagtgatcctcctgcctcggcctcccaaatacacctaaattttatgccacattcctctacaacaaattccaaagttttccaggcaagttttcatataagatggcaatgcaggaagtacttcaccacaggcaacagttattttatgaataaataagtgataaagtacaaatttaaatgacctttaatcagtctttgtctctgtgtgagaaactagatcagtcacctcatgtcactaatacgtccttcaaaatctatactgatccaccatgtacttcacctctctgcattgtaatttcctcatccgtaaaatggagacaacagtattaatggccaggtgcgatggctcacgcctgtaatcctagaactttgggaagccgaggtgggcagatcgcttgaggtcaggagttcaagatgagcctgggctacacggtgaaactccgtctccactaaaaatacaaaaattagctgggcatggtggtgggtgcctgtaatcccagctgcttgggaggctgaggcagaagaatcacctgaacccagagggcagaggttgcagtgagccaagattgtgccactgcactgcagcctgggtgacagggtgagactcagtctgaacaaaaacagtatttgtcacatagggtcactgtgagaagtaactatatgtcaagcagctagaacagtatatagaatactattcatactattagccagctactattacactaataattagtatacttttattagatggtagttcatagctacttcccaagacaaaaaatattaataattgtgaacaatgcaaggctgttttctgatctagaatctatttgcttaaattttaatgagttacagtcatacatcctactagtaacaacagaaaggtcagtataatctgtattactctgataatatggtcttaaatttggtacttcttttttattaccaccaagaagtaaacctcatattagtaatctctttccaaaattttattggttgttatccaataaccctatatagaaaattaacttgtttaatatttatgaatgtatttgacaaagtgttcataattgtaattcatcagaaaggcacagcactcaaaattagacattcctttgaagcattattaatatttttagtggtcaaggagggttgacatataacatactttaaacactttccaggctgcaattaggtcaactgtgatctgtggcagtatttctcaagtggggaatgtggaccaccagcagcagaattacttacggtgtgtgccaaaaatgcatattcctgacctctgctccagatatattaaaacaaatacctttagctgtgaggtgtaagaatctgtattttagacaaacattcttcacggtacccacattaaaattctagagttaaggctatatggtttaaaacaaactgatcattaatcaatggtgaatgaacaaaatggtgaatgaacaaaaaagttttcatgaagaagttctagttttgattaaaaattgctctgtaacctactttaacaaaaatagctggccacctaaccaaactagagtctgagttacagtcattttccattataggttatcaattgtatcaccgcctcattggatttcaaagttatcaaccaacaacatagagcactgcatggcatgcctttgcagtgccatccactgaataatctattaaaagctatattgcaaaatgtgactctttcaaagacaaacagctaattcatttggtaatctagaatctgtccttatgtaaacaaaagcatgagaaaacaacaattttagactatttaattttgacctttcacaaactaaccttcagtgatctccaagtgtgatacctcattttagtaagtcactttatagctaccttataaaatcatctactgtatttacagtagaagtagtactgaagttatcataggttacagaatttattggctgttacagaaaactccagtagagaaatcccttacagagggaagaagcaaggaaagcatttattcccctgaacaatttatatatttctctcctctggggaatatggcatagtttataattctcttttcattttgactatcatttaaacaaatcttatactcaatattaataactatgtaaaatagttgctaatggcttgatttgtaatgcatattctctagtacaatctatatatttggatgtgatcaattcttctggtctgaagcagggtataaacaaatatgtagtataaaaggaagggcagtcttctggaataactgcttattccaggcctatccctgctgatgaatggtggcaatcaaagcattactctgactgccagtcttacagtgatcaactaagccactaactactatctgtatggatgcttaaacatgtaattcagtttactgtcattacatcttagtttctgcaaaaagagccctttaaagtacattaaaggaatgccttagtatcatgatccagagcatattcccagaattctagggctctaaacacgtggctaaggaactgcttgtgaggtggagggcggggtaggagcaagaggacaagggaggacttgggccacaagaacagctccacttttatctctttaagacattgtattcctttattcagaaaaaagagagactttttctagaaaacggggaaaagatcccacagattcgaaaactaaggacatctgcttaaggacaagaatgactggaatcttacctccttcacatctgagttactaagaactagttgtaatgtctcaaacacactgtgctatctcatgttcatgacagttaattttgctttaaatgttctcatgtcttatccaccatgcgaactttttcagaaatctttctttgttctaggacagacttaatcatttcctctttagtggtcccactatcccacattcatctctccattacaggaattatcataatgcattacaagtgttttcacttatttgttccttctcaaaccgtgtggtagataagatttacaacagcatcctcaaggtaaatacaaaagtcttctagagaatttcttatactactcaccaaagtaaactgacagcataaagatatattaatgtacatcttatttaagacagatctttggtgtactggttaacaatcctcacattaggtatcacagatacataaatgtctagatgttatcagaggtactcaaagattaagattaagcacatgtggctgggcatggtggctcacgcctgtaattccagcactattgagaggtcaaggtgggaggattgcttaagcccaggagttccagaccagtctgggcaacataacgagaccttgtctctacaaaaaatttaaaaattagccagatatggtgaagcatgcctgtagtcccagctattcaggaggctgaggcgggaagattgcttgagcccaggaggttgaggctgcagtgagccgtgattgcaccactgcactccattctgggagacagagcaagaccctgtctctaatattaaaaaaagattaagtgcattcatgaatatactttaaataaaatcacagtaataagtgaagctgaaaagctaacaactactatattagagtttcctgtatgtgctatagtagcatgtcctataactgtaattttccaacctgatggccaagatgatgatgtctgacattagttgggatggcaattactagaaatggaaatgaagccaaggccccacttgaaagactataatgagtcacagttgaaaagaacaaagagaagctcatttcaggccagggtaacagcaagtgcaaactctactgcaggaaagggactggtgtatcaaaggaaaatgttagaatgagctagagaaaaatgttttgaggtcagacagagaggcagtcaatgccatatgaaaccttgtagaccatggtaaagagtctgaatattagttaagcagcagaaagccactgaagtcttaagcatggctgtgatttgacataatttataatactaaaaaagacttctggtttctatttggacaatggatttcacacaggcagccacagaattaggaagagaagttaggaaacaattggttgatatgactagtagattgatgaaatagatgaataatctgtaggaaagaactagagtaataaagttgagtatcatcagcatataaattatatttaaagccttggggtcagattacttgggaagcaaatgcaaacagagaaggcccaggacatagccttaaaatatcacatttatcttctggagacttccagctctggccatgagagagtaataatggccagacttaacttccacaggaaacaactagaaaactggacaaaatacatgacattgtgtttagatattaaacaataagcagcacaagactgtgatccctgtgagaagggaaatgaatgaagtaaaccctaccactaaactggctttctgcctggagaaaatatctggactttgggtgcagccttgctagactgatgagacaaagatcaaagtccagggaggtagaactagaaaagagagattcattaaaataaaacaaaaaaaacttcaaaactttgcaaggtagttttcttgagtctttgatgagcacaggccatgaatatgcagaatgaaacttcacaaagctaggccaaaacagctggggagttgtaagctgaacaatgctcagagctcatgcaggtaggagatgatcaaactgaccgggagggaggtgtttcctcaagatcacctgtgatgtacagtggaggccctagagggtcatgccttggaaataagttaactagctctagaatgaagacaactttacacttgtcctagcaaagcttaaaaacaaagtttaaaagtgtaaaatagatccacaagtaacttgactaacttaaacccaatactctttacaggaagatagtaataacaaaaaaatcagagacctaggaatataatattcacaaggtccaccttcaaataaagaattataaaacacacccagaagtaggacaatatgatccataaccagtagaaaaataagtcaacagaagaagatacagagatgatggaactcgcacataaggatattaagccagctattttaatggagtattaaaggataaacacgaacataatgtggagagaaatgaaagacacaaaaacaacttctaaagataaaacacacaatatcgaaataaaaggttcactgagtgggattaatagtatattattgcagaaaaaagataagtaaacatgaatacatactaatagaatttatccacaaggaagtacagagagaaaaaaagactgaaaacaaaatgaacataatcttagtgacccgtggaatggtatcaaagagtctaacatatgtaactggagtcacagaaaaggtagtagagagagagaaaaaatatttaattgaaataatagccaaaacttttccaaatttaatgaaaagtataaacctaagggtccaagaagatcaatgaaccccaaaacaggataaacacacacacattacagaccccatatacagcattggtcccataagattataataaagctgaaaaattcctctcaccacctaatggcattgtagtgtcatagtttaatgaattactcatgtttgtggtgatgctgatataaacaaacctaccacactgctagtcctataaaaccttactccaaaaaccttactccccaaaacccttaccaaagcatttaataatcaaaatgctagaaaccagtgataaaaaggaaactgtaaaagaagccagagagaaagatactctatatacatgaagataagaaagctcacatatttcttagaaacaatgcaacccagaagacaatataattctatatctagtgaaaatatccactcaaaatgaaggtgaaatgaaaacactttcatacaaacaaaatctgaaaaaaaaaatcatcatcaacagggctgtgtaagaagtgttaatggaagttcttaaagtggaagaaaaagaataccagatagaaacttgaattctgcacaaaggaacaaaaaatgtcagaaatagtaaacatgtaaatataaaatactttccaatttctgacttctgtaaaagataaatgaatgtttaagcaaaaataataaaaatgtattgtggaatttataacgtggtagaaaaaatacccgacaacaataccacgaaggacaggcaggacgggaatggaagtacagtcatgctttgcttaacaaagatacgttacgagaaaagtgttgttaggcaattttgtcattgtgtgaacatcatagagtgtaattacacaaacctagatggtattagcctactacatatctaggatatgtggtacagcctattgttcctaggctacaaaacctgtatagcatgttactacactcaatattatagaagattgtaatacaatggtaaatatttgtctatctaaacactaaggtatagtcaaaataccatataaaagattaaaaatggtgcacctgtataggtacttaccatgaatggagcttgtggaactggaagttgccctgggtaagccagtgagtgagtggtgagtgaaatgtgaaggcctgggacattagcgtacactactgtggactttataaacattgtatacatagactacactaaatgtatttaaaaattttctgtcttcaataaattaaccttatcttactgtaaccttttcactttataaacttgaagacacaaacacacacgtcagcctatgcctacagagggtcaggatcatcaacatcactgtcttccacctccaatctagaaagtcttcaagggcaataacacgaatgaagctgtcatctcctgtgataactatacactatacactgaaatacctcctgaaggacctgcctgaggccgttttacagttcactttcttttaatacgtagaacactccaaaataatgataaaaagtaaagtattaaaaatacacaaaccaggcatgcagtcaattattattgttgtcaagcattaggtactgtacataattgtatgtcctaaacttttataggactagcagtgtggtaggtttgtttacatcagcatcaccacaaacatgtgagtaatgcactacactgtgacactacgatgtcattaggtggtgagaggaatttttcggtctattataatcttatgggaccactgctgtatatggggtctgtaattcactgaaatgtcattatgtgatgcatgactgcctatagttgtaaggtttttatgacatatgtgaagtggtataatattatttgaagggagattatgctaagctaaagatgtaccttgaaaacaaacagtagagataaaataaggtgctaaaaatactaaatccaaaggaaggaagaataaaagtaaaaagggaacaaaaaagtgatcaaatagaaaacaaatagcaaaatggtaggtttaaacccaatcatatggttgtgatattaataattacattaaatgtaaattgtctaatcaattaaaagagattgttagacttgttaaaaacaagacttgactaacatgctaactgtaagaaatccactttaaatataaaatgtttggttaagagcagtaaagaatgtatatataccatataaagattaagcataagagagctggaatggctataataaaaccagagaaaatgtttcagacaaggtgatatgaccagtgataaaaggattcatttcatggtgacaaaggggttgattcattaagaagacatattgattcttagttcaaatgcaactgagtggaaatttcaacactccttttcagtaattgataagtagaaagaaaatcagtaaggatactgaacaacgtgatcaaacaaaaaggatacttcataaacataaacttatcaattcatccaggagacataagaatgctaaatttttatttgccccaaaacagaacttcaaaatacataaaataaaaactgacataactgaaagaagaaatagttatctatacaagttgatatggtttggctatgtccccacccaaatctcatctggaattgtaatccccaagagtcagtgaagggacctggtgggaggtgactggatcatgagggcagatttcccccatgctattcttgtgatggtgagtgagttctcatgagatctgacaatttaaaagtgtgtggcacttcccccttcgtgcccacgctctctccctctctctgtctcctgctgccatgtaagatatgccttgcttccccttcaccttctaggaccatgatggttaagtttcctgaagcctccccagccatgcggaactgtaagtcaattaaatctattttcttcataaattactcagtctcaggtacttcttgaaagcagtgtgaaaatcaactctacacaagcgtagttaagaatttcaatcttctctcagcaatttatagttcaaatagattaaaaaatcagtaaagatgcagaagacttgaacactatcaaccaatttgactttatagacattcatagcatatttcacagtagaaaaacacacattatttttaagaaatttgttagagtaggatccaccagcagtggagacagaagagtgactactgagttcagagaaaaactaggaaagtacaatataaagggagccaacagataaagtgaatttaaaagtacagcatatatgaactctgaaaagctaagaaaggtgaaagagaaaacggtgcagagaatttggcaacatactggtaactgactatctgaacagagccgcttcagtggacgagcaggctaaaagccatgctggaatgtattgggaagtgaatgtatgtggaaactgcaatgagactgcaacatagtcaagatgcttggttgcaaaaggggatagagaaatggggtcgtaggtaaagaaggatactgtgctcaaaagaagtttgctatttttgatgagatttattagaacatatatgttgagtaaatgatccactatagaaaaagttgatgacacgggttagagtggcaaaattaatggagtcagttccttgaagagtgaggaggtgggatccaaagcacaaggggaatttcctcaatcaagaaaaaaatcccaccagtagtataacttaacatttgcaaaaaagagttttaaacatgcttataaaaggttaaattatcccaccttagtaaacagattatataaatatttatagaacgggcagggatggttttgtgttcttttcctaaatggctacagactgctttgattttctagtgttttttcttgcctcttttcctcatactcctctacatgaaatctgcattgctgcttctaatttgctgtggttacttccagagtaagttcttctatagaactcttaaggtcataaaagaaaatcaaacaatcaaatgtattatgcaaagaatattaactttatagatggcaataggtattaagaagctctgagctaaagatggctatacatctttactacaagaaaagtacatgaattgtatgatagtccttatctataggcctttctctctaactctgaagatcataaattggttttggtagttcacacctttcaaaagactgatattagatacatgaggaaatttaataatctctaaatttaagataagcataagaaaatactccacaaaatgaaagtatacccagttggaaaattaaattgaaaatcaaagtgactatttattatttatttgagacagagactcactctgtcacccaggctggagtgcaatattgcaatcttggctcactgcaacctccacctcccgggttcaagtgattctcttgcctcagcctcccaaatagctgggattacaggcccacacgaccacgcccagctaatttttgtatttttagtagagatggggttttgccatgttggccaggctggtctcgagctcctgagctcaaatgatccgcccaccccagcttcccaaagtgctgggattctaggtatgagccagcatgcctggccaaaatgacatatttaaaaaatagttaaggactaaagaattcaggcagttgattcttttacaggctaaaataaaaaaaaatgcccaatctcatttgtaaaacacagaaacataaatgtatacaaatcaataacattactcatttgataaatagacaatttttaagtaaataataatagtgggtggtatttaacacacagagaaatggatgtactttcacatactattgacagcactataaactatttggaaatcaggcagtatacaatataaccttttgaattccacttatagaaatttattttagggaaataattgtagatatgtacaaagataagaggtgtgattacaacaacaaaaattacagcggaaaggcatgacaatagaaaaagatttgtaaaaagattatgataagcagctcaatggaatatgtagttatttatgatgatataaagagaatatgtgacaatgacaaagtgctattttcatcacagtattgtaataatggcatttgcaataatgtcgtaatatatattgaatagaaaaggttataaagagtatacataaaatcttattttggtaaaaagttatgtatatgcaaaggttatataaagagtaatataacaaatgattatttcttatttttacctgcgtttcaacattttctgtagagatattttttataagaaaaaattggttacatatattcaaaaatagcaagtgagaaaaagaggtccgaaaaacttctaccagaaagtgcatatgaatatctcttaatgtttttatatacaaattaggcaatatagcacctctgtctatttaagatatattgcttaaacttagtgtgatactaaaaatggaagtcaggttgggtagtgggaaagagcaatagtgcatgagggtatataaagggactttttgctcaagtaaaagactctataaaaaaaatcctgaacaggaagccaatgaaatagtctttatcctagttgtactctcaattgcaatttatttgctcagaagatggaggtttttgttggatgtgtgtttgtgtctgtgttaagagattaaaactcaatattatggtttataaaagaaaaacaataatacatgttatcgaatggataatattttccacttgaggaccatacttgcctttgggttgtttgcatcaaacagaccagttgaaagtccaatcagcaaggaattcttgtttttattttttggtggtaaatgcgagtgagatcgaaatgcaaaggattcttctggtgaacactgaactgattgaacttgagggactaagttcaagtgttcagaatgaaccaccttatggaaaaatggttccggttgcacagacttatctacatcacatttagagtgctgagaatcattggttccaggctctgtggtagaaaggagagattatgtggtaagtctatacagtacttaaagttctaaatgatattgataaggcacagtatgtaacacaaattctagcaaaaaacccacatatcaggaaaataaaatcaaaatatgtgtgtcagtatattaccttctgaataatctttaataggatacaatgttctatcttcagagagttgatttaatttgttatgtactttcattatattgaaagttctacaatacagacacaagggtgggcatggtggctaatgcctgtaatcccagcccctcaggaggccaaagtgggaggattgcttgaggccaggagtttgaaaccagcctgagcaactaagtgagactctctctccacaaaaaataaaataaaattagccaaggtggaggattgcttgaggccaggagtttgaaaccagcctgagcaactaagtgagactacgtctccacaaaaaataaaattagctgggtgtagtagcgcatgcctatagtcccagctactctggaggatgaggtgagggttgtttgagcccaggagttcgaggctgcagtgagttatcatcgcgccactgcactccagcctgggcaacagagtgagaccctgtctctcaagaaaaacaaacaaaatgaaaaaaaaaaaaagacataaatccaaagaaaggtgaaaaaatacactatttagatacatatttagctccagtttatctttgttcctataggttagatgaaaacaattattttttcttttctttttaagaaataggtcttggtctattgcccaggctggagtgcagtcttggcctcaagcaatcctctcacctcagtctcctgagtagatgagactacaggcatgccaccatgcctggctaatttaaaaaattttttgtagagatggagtagcgctatgttgtccaggctggtctcaaacttctggcctcaagtgatcctcccacctcagcctcccaaagtgctgggattacaggtgtaagccattacacccagcctacctttcttacattttaactaatactattttaaaaagaaaacaatttatttaatgtccttagtacactggcttagctttggcaagtaattcttttcatttttaatattcaataaaaataactgaccaaaaactttcactgccatgttgccatacaatccaggcttattaatgtagtccagtgtgctatgcctattatattttttaaatgattgagatgactgataaggaatgctttcttatttatatattacccaaataaaacaggttgatgttaataatcattaacatcttccagaaagtaattagactaatgcaatgatgcttacctatatgaatgtcactaagttggtccacagtactcgagactccatcttcagaaacttcattttcctgaatggtgatcctatctgccgacctgccacagatgggtacaccaattaaaaacacacacacttagtttaccagaaataaaagtgctctaaaatacaggaaatggaacacaagttcactagcattctttgatccctcttccaagtatttttctcactttcatatatactttctcacataagtacaatgtatttttcaccctgttcaaatcctcaccaaatagtaatcattcacagcaaccaggctcaccatgttttataacaatggttctcaaagtacagtccccaaacaacggcatagtaaagaaactggttagaaatacaaattctcagcctcacccttgacctgtgaatcagaaactttgggggataacgcccagcaattagttgggaaaagtcccgaagtcattctaatacatgctaatgtttgagaaccactactttaaagaatgggaatgccccttaagagtggagaatataaaacaattacaatatattaataccatggaatatcatgcagctgttaaaaaatgaagcagagatctatataaactgattagaataggcaagatatactgttaagtaaacaaagtgattcacagaccaatttgtattaaatggtgttaggttttgaaaaaatggtttgtagcacagaaaaatagaataagattcacaaaaatattttaaccctcaaagggaggggattaagattgaggaaaaaaaaataaaaaagaactcacaatttttatctctatatgcctgggaattaaattcatgcattttttttaaacaaaaatttaaagactggaagaatatattccaaaagtaccagtaatttatctctgggagttagcttataggtaagtttttattttctaaatacttttaaattggtttcaaattttattttatcttttaaatttatttatttattttgagatggagtctcactgtgttgcccaggctggagtgcagtggcacgatctcggctcactgcaacctctgcctcctgggttcactccattctcctgcctcagcctcccgagtagctgggactacaggagcccgccaccatgcccggctaattttttatatttttagtagagacagagtttcatcgtgttagccaggatggtctcgatctcctgaccttgagatccgcccgcctcggcctcccaaagtgctgggattacaggcatgagccactgcgcccggcctgtttcaaattttaaataattttctactttctcattttcagattttcaaccattttctgcttttattttattttattttatttatttttgagagagtctcactctgccacccaggctggagtgcagtggcacaatcttggctcactgccgcctcctcctcccaggttcaagcaattcttatgacttagcctcccaagtaggtagggtgacaggcacatgccactgcacccagctaatttttgtatttttcagtagagatggggttttgccatgttggccaggttggtctcaaactcctgacctcaggtgatccacccgcctcggcctcccaaagtgctggaattacaggcataagccaccatgtccagcctctgttttttattttttaagcttatatatatatttattttaagagacagggtcttgctctgttgcccagtctggagtgcagtggaataatcatggctcacctcactgcagccttgatctcctgtgctcatgtgatcctcccacctcagtctcccaagtagctgggattacaggcacatgcaaccatgcctggcttttttttttttctgtagaggtggggtcttgctatgttgcccaggctggtatcaaactcctgacctcaaataactctcccaccttggcttcccaaagtgctgggattacaggcatgagccactttccccagtcaagcaacatatttattcattcaaaatataatgtcccttggttcctcaaaaaggtaaactgaactaccatatgatgccacaattccactccaaggtatatacccaaaggaactgaaagcaaagactcaaacagatactgtgtgtcaatgttctttgcagcactcttccaatagccagatggtggaaacaacctacgtgcccatcaactgatgaattataaaaatatatgggatatatatatatatatatataatggaatattattcagccataaaaagaaatgaagaagtggcatatcctacaacatggatgaaaaactaaaaacagtatgttaagtaaaagaagccagaaacaaaaggctatatactatatgattctgtaagaaaaatccagtattgctaaatccacagagacagaaagcagattagtggctgccagaggttggtggggagggaaaaaacgggggatgattgcttaacagatagagaggtgggtgatgaaaatgttctggaactatatagtggtgatggttgtacaccactgtgaatttctaaatgtaattgacttgtacaattttaaatggtgaattttacgttatgtgaattttattccaataaaaaagttaagttcctttcaggactcctaactactcgaattccagttgcctttcctattattagtttggtgcacaccttacgagatttttcctttaaatttacatgctaatctaatctatggagatggttttttcattcaatattattttattccattaatcaatgttttagacatctttccatattaataaagagtcccctttattcttttaggtgctgtattatattccattaatgctttagagttgacccttgaacaacatgggtctgaacttcatgcatctacttagatgcaatttttttttcaaccaaatgtggattgaaaatactgtattcgtgggatgcaaacccgtgtacacagagggctggcttttcatatatatggattccacagaacccactgtgggacttgagtatatgtagattttggtatacgaaggatactggaaccaatccctcaaatatactaaaggatggctgtatacagaaacacagcagtatttttagctatctccttattaatgcttatttagactgttgcaaattattggctgtgactctcctggaatgaatattcctgcatttgcttctttgtgctcatgtatgaaggatctgaagagtagataccaaaagtaaaagaggtatattataggatgtgcacatttaaaacgttaaaaaaactgtcaaatggatctctaaactggctctaccatttcatatatgtatttgcagtccatcaaagaaccatagtcccaatccctcacatacatttgatatgtcatttctcttccccattgcttcatgttattttatggaaaaacaatcagtggaaaatacatcttttccactgatgtggaaaaggactcttgccctgccttttactcactcttctttgaggaggagtaagtatctgactagcagtgacattcacaggaccctagttctccactaagttagtctctcaaacacttaccatctgtcattttatcgatgccctgtaactcctaaagtatcatactgttgtatttactatctggatttcttccttcatgaatagcctattcatcacctttccccatttttcccttggacttctgtctttttcttattaatttatacacattctttataaattctggatattaatttttatgttaggctgcctcctttaaaaattttttatttaggtctttaatcaatctggtattgttttgttgaatgatttcagaaatggaaatgattattttatttcttccaaattgtgatttatttgtcccaaaagcaggtattaaataggttatctttttatgttgattagaaatctttaccatttattaaatttccacacacatatcaaacaccggttttctattattcctataatatgtaaaaatgatttaaaaaatagaaaacactctctctgcctttaaggagctttttttgtttttgtttttgttttatttttgacagagtctcactctgtcacctaggctggagtacagtggcgcaatcttggctcaccgcaacctctaccattggttcaagtgattctcatgcctcagccacacaggtagctggaatgacaggtgtgcacacaaccacacctggctaatttatttgtatttttagtaggaacagggtttcgccatgttggccacactggtctcgaactcctggcctcaagagatctgcctacctcagcctctcaaagtgctgggattacaggtgtaagccactgggcacatactgctaagcaaaaggggccaatctaaagacttcatactatataactagatgacattctggaaaaggcaaaactatggagacaataaaaaggtcagtggctgccagggattgtggggtgcaaagaagacaggataaacaggtgaagcacagaggattgtacagtatcataggaataatagtgtaatgtgaatccatgtcattacacatttgtcaaaacttgtagaatgtaccaaatagtgaaccctaatgtaaactataaactttaagttaatagtaatgtgtcaatattggctcatcagttgtaacaaatgaaatacattaatgcaagatgttaaaaatatcacttgtcaggaataagaaaaaaaaaattgttgggggtggggagtgagaggtatctaataagtctataatttttgctcatttttttgtaaactaaaattgcttacagaaatctattagttaaaaaaaccaatacagccaatacagcaaaagactaaaaagaatatacaaataaaataaaaatgacaacaaaattcaactattatatcatatcaaagatatagcatacttctgtaaattaactagatatttaaatacaaaaatttcagattgaatcacgaacgatatcagaaacataataaaataattcagaaaagctgaaaacagaaggatgagccaatgcagattgggaaaatataaataaaaagataaaacttagtcaaaaatattaagcaagactaaaacaatgatattttataatgctataatgtgtaatttaccacaagagtattatacttgtgaatatctatgcaccaaataacttaggagcaacattcattagataaaaatcacttgaaatataaaatgaaataaatggaaacacattagtaggaagaagccttcactcatttcaatgaagtgaataaaaattgttaagtatatagaaaacctaaataaaaaacctgataaccgatacataacaatgccaaaatattttataatttattaattaaaagtatgtactagcttactgtagacagactaataggaaaaaatgtatacaaacagactcaaatctataaaccatgataaattccacagatttacatgtaaaaaaatcaaatatttaaatgtataaagcatcaaataaaagtcctagaatgctggccaggcacagtctcatgtcagtaatcccagctctttgggaggccaaggcgggaggattgtttcaggccaggagtttgagatcaacctgggcaccaaaattagactccgtctccaccaaaataaaaaaaaaagaaagaaaaaaaatactagaaaaactgaaaaaaaatttggtaatcttagaaagaacaaggctgttctgagtaactatcaaagctcagataaatatgataacaataaaagataaacaaaaataaactatatacttcagcatggcaaaaccacacacacacacacacacaaaacataaatgaccagcagagaaaaaatagttgcaattcatgtaaccaccagggcaaatatctctcacttttaagagtttttactaatttataaaagaccaacgactaaattaaaaaaaaaagggggggaccaaagatataaagagaaaattcacagacaaggaagttcaaatgaaacttacatttgaaaagatgtgcttacctttacctatcataagagctagacaaactaacagcccaaacagatatactattttttaccttgttagattggaaaaactcaaaaagtttgatgagaaaagtttagcaaggctgtggagaaaatggggttcagacattctttctgaaagtgtaaaccagtacaacctccaggagaacaataaccaaattacaaatgcaacttataaaaatgcagttgaccaagcaattatacttattacagatatatacacatacgaaagtcactttatataaaaagttattcattgcagcatcatttgtaatgtcaatcaatgtccagcaggtaggaaacttgttgagttgtggtattctacataatggaatactaactagctataaaataagaaaaaaagaaagcccttcatgtattattatttaaaaaatttcccagatttattattgaccaaaaataaacaaggtggaaaaatctgtgtacactatactaacaaatgtagttaactgtaaggaggaagacaatatatttatttttgcttaagcatatactagaaatatatgaaagaagacaagagtggatggggacagatgtaagcaagactttttactgcatatcatcatactttaattaattaattaattaattaatttgagttggagagtctgttgcccaggctggcatgcagtggtgccatctcagctcactgcaacctccacctcccaggttcaagtgattctcctgcctcagcctcctgagtacctgggattataggcacccgccgccatgcctggctaatttttgtagagatggggttttgccatgttggccaggttggtctcgagctcctgtcctcaggtgatccgtcctcctcggcctcccaaagtactgggaatacaggtgtgaaccaccgtgcctggcccactttattttttgtgagacagtcttgctctgtagcccaggctggagtgcagtggcatgatcttggctcactgcaatctctgcctcctggattcaagcaattcttgtgcctcagtctctcaagcagctgggactataggcacgtgccaccatgcctggctaatttttgtatttttagtagagacagagttttgccatgttggccaggctggtcttgaactcctgccctcaagtgatctgcccgcctcagtctcccaaattgctgggattacaggtgtgagccactgtgcccggcctcttcaaatattttatatacttgtttatttctgaaccatatgaatatctattcaaattaagttccttttataaggtattacaatattaggatattatgttgcaatattagcttattatagtattttcttaaaagttattacaaaagggacctgggttttaaaatgtcaggaaaagatgtacatactgagtttcctttgtttctttttcctcactaatccacacatcagtaatagtgcatggcaagctctcatctttgtttgttccacttggctcttgtagaatttctgtttccaaatcatcaggttctgcaaaggataaacgtaacgagagacatctcaaagcaaaatttgtcaagagaatattgaataaacttgctataaattattgctacctagttttagggtaatatattcattaaaacagaaaaattaagtattctctctatagggtttaactcttattgtgaagtctttagttcagttatttctgaaacgacagactacttcttttgccttttactgtaataaaaatgctcaaaggtaatatggtatactctatatttttcaccattatgtaaaattttctcttcaattaaaattttagtaatatgtaaattcatttagggaaggtataaaaacagtttaaagaataaagatatttgtggttagaaatatggaagaatagactgtgatattactgattagtgactaaaataaaatttcaatcttcaaaatctatcttttaatagtcaaaaaagaaaaactattaccaggactttcacaatgatattgagaacataattgaatggcactaaaaatctattttcttagacactcaaatagtttttttttttttttttttttttgagacagggtttcactcccatcgcccaggctggagtgcagtggtgtgctcttggctcactcactacaacctacacctcccgggctcaagtgatcctcctgcctcagcctcctgagtagctggaactataggcacacactaccacaccaggctaatttttgtatttttagtagagatggggcttcaccatgttggccaggctggtctgaaactcccgacctcaagtgatccacctgcctcagcctctcaatgtgctgggattacaggcgtgagccaccacgcctggcctgaccctcaattaacatcaagatgttacctctgttttctggcagtggctcatttttcacctggctaatattttccaaaagtgaacagcgatgaggagagtatttgttaacttctctttttcctttccaattaagattatcaataatatcctgtttaagccaacactatccctcttacttcccctggaatacagacatacttctccatttttaaagcttccaattatctgtcttatttggaaagacaactgatattgtactaatctttaagtttttatcttttattcaaatgattattttggtcattcattcaaggtaagcacttgggggcaaaatccttttttattttttaatgaataattctgtttcctagtactttaagctgtatcattatcaacttattctataaacttgacttatgactgcattacctgcaaagcctagaatatttattctctggtctatcaactcctgcactaggctatacagcttccatagtatgcctaacactattttcttttcttttttaaagaaaaggcataagatactgttttagttcaggctactataacagagtatcatagactgggtggtgtaaataatagaaacttatttctcagagttctggaggctgaaggatccaatgtcagggtgccagcacggttggttctagagggccctcttcctgttttgcagataaccttttcctccttgtatccgtatgtggtagaaagcagaaagctctctggcctattcttataagggcaccaatcccattaatgagggcgccactctcataacctaattactttgcaaagactccacttccaataccattacatcagggattagatttcaacatatgatttttttggggggtagggaggggaacaaactttcgttccataatgatactagtaactatgttctaatgaataagattatttaagttactgtggtgaattaaggatggtcacattttgcagggtttctggttttcctctcaactagagggagctctgtttctcctcctctttaatttcagctggcatggtgattcccttgagtaatggaagacagtgaaagtgatgctatgccagttccaggctgagcctttaagagaactgggaacttctatttgatatctggaagcccaagccatcatgaaaatagtttattcttaaagaccacattgcaatgccatgagactaaaatgaaggagagggacccgaataagccctgccaatatgccaggcatgggagtgacgtcattttgcgtcttccaaaaaagcccagctgatggctgaataccactgagcaataccagttgatgctacatggagcagaagaacctccaaattcctgactcaaaaaattgtgagataacataaaataaaaataaaaattgttttttattttggagacaagttctcactctgtcacccaggctggcatgctcatggctcactgcagcctcaaactcttgggctcaagtgattctcccacctcagcctccctagcagctgggattacaggcatgcaccaccacatgtgactaattttcatattttcagtagagaaggggtattgccatgttgcccaggctggtcttgaactcctgggctcaagcgatatgccagccttggcttcccaaagtgccgggattacaggtgtgagccactgagcctggcctaaaattgttattttaagctactaagttttaggagtaatttgttttgcagcaatagataattgaagcagaattacatatccggaagcaaggagctgatgtaaaagcctatgtgcactggctttgggactgcggagcaggcagaaattggaagggcttcaatgacattgttggtgagagactggcaagtgaaaaacagttactggaggctgaagaaaaggggattcttgctctacggtggctgaaaatttggtaactgcaataatgtggaagatagtaactgtactttatggatccagtggtctagctaaggaattatcaaagcagaacattcaaagtgacagctgcttctaataacttctgataaagaacaagaaactagagattaattgaagaaaaaagtttagcttatgagcagaatttagaagagatacagagagcccaggatgattccttctaggcaacaaatgcttctcaaaggaagacatggcctcaagacaaagactaaatttaggacagtagggtgtggcctcagggcaaagatgaagtcaaggttgtgcacataagatctgttacagcacagaaagatttaaaggcatgtcttgcagaccctctttgatagagaaagaatttctaagaactcaacagcactgtcttacagtatcctcatagataactgaaggtagagaagagtctgtctcagaaacatgagtggcttttgttaaccacagtgagtatcaataatattcacataaacccacaaaattatttagaaattctgcttttggaagcactgtgtaagctcagactgaaggggacaaacatagtgcaaaagagaagagcccttgagcacaccaagctttggtgcaaggaagcaggctgacaatgctattcctggttggattttagaatttctagggaccaatgactgctatctgcttcccatcttccttgttttcgaaaaggtgtcccaaaggttgtttcaccattgtattttgcacatatggaaaacaaataactaatttttttttttactcataggtcttcagattgagaataactgtactcaaagacctgtagatgagaaaacccatctgcacggcctgactttgttatcatattaaactctgagctaatgtcataatgagatgaggctttcagaaggtgtgagtgtattttgcatatgggaggaatgaagataatttttggtcagagggcagactatggcagatttaggacagatgcaaattctttgacgcccttcccattgagaggtgggttctgtttgccctccctttgaatccaggttgggctgtgactgctttgactaatagaatacggcagaagtgatactgtgctagttctgagatcagcttttaagagtacaagctgctttcaccttagcatctgtgagccccgggccatcacataagaagtcagactatcctgccagaaagagtacatagaatagccctgaaaccacataaagagggagaggggcccagctaagctgtacttgccaagatagcagtgaagctttttgggacccttcagaccagcctagctgccggctgaccaacacttactgatctctgagataaaggcacacgaattaggaaaaatcacattagacaagtcttgactcaattcctggcacataaaatcatggtatgaaacggttggtgtttcaacactaagttttggggtgacttgttaggcagtcataaaaaaaagaccaatagctaaaaatataaaaatactgaacctaatttgagataattacccaaacatatacaaattttgataatctgtttataaagcttgtgaaatttaagtttttactaaatcaaatatagctcattttgactcattagaacataccttctaaatttccttccagtttcaatgacatctgtggagatgcctcactgaactcgggactttttgtctcaacaggagaatcaacaatagctgatgggtttatttcatgtgaaatacattgtacttttttttctccagtaattaagggtttgtacttttccccttcgggagaaatctctgtgaaaacaaaaaataaaaaatcatgctagttctcaaaatgatgcattttatctgtaatggcattgggggcaaagttcaaaaagctgcattactgcaacaggcaattactagttaagctctgttacatattagaagttaataagtgactacagtatatgaaagtcaaatttcatttcaattgtacataataatttctatggtggtcaaaatggtttaccttctttctgcttttggtaaaattaatatgtgtattagaatactattttttaaattattaactagttgattctgtttatatgaagtaactcctagttacttctaattgctctgaaattctccacactaaggagagaggaggtttacctcagaacatcctgagacaggttcaaaaaagaataaaaagaaaaaaaaactacctcagaatagcttaatgcagttatttaccaccttctcactcctattaatccgttgaagattttactttccaggttacaagctccccaacactaactctgtcataactaatttaggtgatttctatatttgtatcaataatccttccaaaaggtaggcctcttggtttgttgcacttcactctacctcagtcttcatcctatctccagcactccaatggtcatatcttagagaacttgtcattaattatagcctctttaaatttccagtgttaagtattccaccctctaatctctaacactcattttccacttctccgcctctacaactccaactctaaaaaaattttaccctgaaagtacctacaatgcactgattctgctacattttctgtcatctccattaaaattcacagaaattccataatatagtcattctcttgtgcatcctcaacttattgtattcaagtggcaaaaccccaattttgcataaattcaattctctgcctactatatctgcatacacagggttaaaatggttgaagaaaaacagaaatccttgctcattggtctcaatttaaattcattgtttctaaagccaagtaggccctttgtgttggctgcagtccttttataacactgggctagcaggaactgtccttagctcagttaatttccagagcaaaaaagttgttcatcaagtatttataagttgttttactctttacttctttctagtcaacagagaacaaaactatagtgttgcaaatgtttcagaatcatttccctgcactgtacttcaacaaactgcttgccaaaacaaactgactgtagcagagatcacatctgtgtttttcctccttcagccctaccattctgcaataaaatcatgtctattaacaccaggaatcaggataccatatcgcattattattattattaaagattgctttagtgggttctaacagaagaataggaaataatcaaaatataggataaaaatctatttcttgtcactgatgataaatctgcacatttggaacatctaatatctcaaggaagaaagcttaatagatttagtaaaaataatcagtacagcgtccagatataaaattttctatctatatatagaaagaaataggggaaggaagaggaggaggttagggtatctttttttttttttttttttttgttagagacctgagttttgctctgtcacccagtgcggtggcgtgatctcagctcactgcaacctccacctcccgggttcaagcaattctcctgcctcagcctccctagtagctgggattacaggcgcacggcactatgcctggctaattttttatatttttagtagagacagcatttcgccatgttggctaggctggcctcaaactcctgacctgaaatgacctgcctcagcctcccaaagtgctgggattacaggcatgagctaccacacccggctggatagctatactagataaaaattcttaaaacatagcaaaaagcaatgaaatataaaaaagggcagagaatataaacaggcaattttcaaagcagcaaatcaaaatagtcaatagaatgcaacataatgaaattcactcacaatcagaaaaggaaaaataaaaccaatgaaatatataccacacaaaaatggtaaaaaatttttttaaagggatattacctttcaggctgtttgatatttaaaaatcaatcaatgcaatttgcaacattaatataataaaagagaaattatactattatattaattgatttggaaaatgggtttggagagagcttcagcatggctgaccacagacacctggcacttgtctgttccacaaagaagtacaaaacagcaagtagataataacacattgaatagagcatctgaaagagaacacaggaattcagccgcaaagggatggggaacctctgaggcatggaaggagagggaagcgaaacagttggcctggctaggactggctagaagccaggagaaacaccacagattgacctgcctgaatgcaggaaaatggtaagagagatccccagtgctccatgttctcaccatggactcctgcaagcctagccatggctcctcagccctcaagcgccctgagactagtagaggaagctgcctggagtcaaagtgatgcattattctagagaggaagtttgtgctggatctcacacagcatcctgagacccaagcagctgcaacatggtgccactttgagaacccaatccctaccagataacaacctgccccagggctcaacaggccctgaatctccacacccctggagccctactgacatttactccatgtccacctatagatttgcaaccttgtgacatgagctggactcaactgtgcagccaggtccctagtcctctagcccacatacagtcctacaccacaggaaatgggtggtgcagcacattaggaaggctgcccctgggaaaaagggagctgaagcatgtgctccccagagcctgggagctgccttcctggagttgctggtactgacagcaaccctgcctcccctagcacctgggtgaatgtgcacttgtgtgcaccttcaggagcaaggagataggcatgcttgggtgccatcctagagcctgaggtcaggcctggcccactcactgatgccaccacctgagaatgctacctggtagctgggagatcgatctgccccatgcatcagagctggcactagcaagcatgtcatccaggactggagatcaacccaccatgcctgctgatgcaggtgcctgcacacacagtcagggggcctgaggacaggccctcctgcctaccaccaccaccactgatttctgagtgtgcagtctggggtcctgggggtagacctactgtgctaagcacaacctgtgcctgacagcaccatcacagggcttgaagacagacccaccctgccctgctactgccttggcaaaggcctgtgagcatcatccaggggcacagggatcaatttgccatgcctattgctgctagtgcctgtataagctttccaggggcttgggaaagggcccacccagcctgccagcacccacacacatcatctagggtctagagatcaaccagtcctgcccaacataaactgcctgcacatgcaccacacaggggcccaagtataggcctgctctacctggcgatgcccccaatagtgctatgtgtattgtccagaggtctggagatctacccacctctgtccgccaccacagacacccaaacataccttccagagggccctgagacccaacctgcagccactgccaccatccacctgcactaaaggcctggagactagccctctcagttcaccaccaccactgctggtgcccatgagtgctgatgatggacccagggactagccctgcccacctggcccaccactgctactgctggcacccaagtaagccatgtggaggcccaaggattacctggacccactatcaccagtgcctgaacaccatctggggggccaagtacctgcattctcagcatgctgccaagactggggcctgaggactggctcaactggctccctgtccacggtaaatccttaccagagtctccactaacaatcataacctaagacacacaggaattcacagataccactgacactgattacagccaaagaaatcatatgaagactgcactactctgcccacccagaatcaaagccaaaacaccctactcaaccaacactatggatacatatacgggaaaaagtctttgcctacgaaagtcaatccgtaaaatcggaagaagtgattattacaatagatgcacagatatcaatataaggacacaagaaacatgaaaagtaaggaaacatgatacctccaaaagaacacggtaattctccaacaagattccaacaaaaataaatctacaaaatgcctaaaacaattcaaagtaaaattaaagctaagtgaggtataggagaacacagataaataatacaaagaaatcagaaaaacaattcatggtctcaatgagaaattcaacatagatatcattaaagataaccaaacagggccagatgctatgactcacaaatgtaatcctagtgttttagaaaaggaaggcagaaggaccgcttgcagccaggagttggagaccagcctgggcaacacagtgagatactgtctctacaggaaattctttaaaaagtaagtcaggtgtggtggcatgtgcctatagccatagctagtctggaagataaggtggaaggatctcctgagtccaggatttgaggctgtagtgagctatgattgcaccaatgtactctagcctggatggcagacagcctgtctctaaccaagtaaaaatattttatctatctatctatctatctatctatctatctatctatctatctatctatctcataatttgagaccagcctgggcaacatggcaaaactctgtctctacacaaaataaacaaaattagccaagcatggtgtcaaaagcctgtagtcccatctacttgggaggctgagatgggaggatcccttgaacccaggaggtcaaggctgcagtaagctgtgatcacagcactgccactgcactccagcctgggtgacagagccctgtctcaaaaacaaacaaattaactaacaaataaaaccccaaacccccccacccaccacaaaattcaatgaattaaataaaattacaactgagagcttcaacaatagactaaacagaaaaaagagtttctgaatgaaaacagttctttcgaaataatccactcagaaaataaagaaaaggataaaagaaaaaaaaagaatggaagtctatgtgacataagagaaattgtaaagtgcccaaatattcaaattttgggtgtttcagaaaaaaaaagagatgggcaaggacatagaaaatttctctaacgaaataacagctgaaaatttcccaagccttgtaagagatatagacattcagatacaggaaacttaaagacacaaaaatattcaacccaaaaagatcttcccaaggcacattacaatcagacagttaaaagtcaaagagaattctaaaaacagaaagaaaagagcatcaaattacatataagggcacccccaacagactaacaatggctttctcagcagaaaacttataagataggagaaaacgggatgatatattcaaagtgctgagaaaacaaaaacaaaaccaaaaacaaaccaacaacaaactgtcagccaagaatactatacccaccaaagctatccttcaaaaatgaaggagaaataaagtctttcccaaagaagcaaaaactgggagaattcaacagcagactgatcctataagaaatgcttaagagagcactacatgtggaaataaaaggacagtatctaacaccatgcaagcacattaaagtataaaacctgacagagcacattcacaaacaaaagagaaaaaggagtcaaatgttatagaaaataaccaaactgcaatgaaacaataaaagagaaagaaaagaacaacaaatatacaaaacatccaaaaaccaattaacaaaatgactagagttaagtcctcacctatcaataataacctctaatataaatgaaataaattaatcatttagaagatacaggttggctgaatggttaaaaaaaaatgaccaaactacatgctgcctacaataaactcattacatatatagactgaaaatgaagaaacagaaaaagatattccatgcaaatggaaacaaaaaaagagtgggagaaggcatacacttatatcagataagacatattttaacccaaaagctgtaaaaaaagacaaagaaggtcattacataatgatgaagggaaaaattaaatgagcagatctaacaattataaatagatgtgcactcaacagcagaacccctagatatataaagcaactacagggagagatagactccaatataataagagttgtggacttcaacgccccatggacagcactggacagataatctagactgaaaattaacaaagaaacatttgatttaaactgcactttagaccaaatggacgtaacagacatctacagaacacatccaacagcagcagaatatacattcttctcatcagcacatgcaacattctccaggacaggccacatggtaggctacaaaacaaatctcaacaaattaaaacgtaactacttcatatcaagtaccttctcagaccacaactgaagaaaactagaaatcaatcacgagaggaactttggaaactgtacatatacatggaatttaagcaacatgctcctgagcaaacattgagtcaacgaagaaattaagaaggaaataaatggatttcatgaaacaaatggggacagaaacacaacaaaccaaaatctatgggaaacagcaaaagcagtgctgagagtttatagcaataaacacccatatcacaaaagggccagaagctcatggctgtaatttcaatattttgggaggctgatgtaggagaatccttgaggccaggagttagagatcggcctgggcaacaaagtgagaccctgtcactactgaaacaaaaacaaaaacaaaaaatagctggtcatggtggctgcctgtagtactagttcctcaggaggctaaggtgagaggattgcttgagcccaggagtttaaggttatagcaagctacaactgcactactgtactccaacatgggcgacagagtgagaccctgtttataaaaaaaagagacagatttcaaataaataatgtaatgatgtatttcaaggaactagaaaagcaaaaaaaggtcaaatccaaaattagtaaaagcagcaacatggatggagctggaggccattatcctaagtgaactaactcagaaacagaaaatcaagtactacatgttctcacttataagtggaacctaaataattggtacacatggacacaaaggtgaaaataataagatgatgaggactccaaaaggaaggaaggagggagtggggagaaggcaaaaaaaaacaaaacaaaactatcaggtactatcatcactatttgagtgatgggttcaacagaagcccaaatctcagcattatgcgatatacccatgtaacaaacatgcacatgcacccactaaacttaaaacaaaacaactatatacatatatatatatatatacacacacacacacacacacatgcacaaaatggaccattattcagccataaaaagaatgaaatcttatttttttgcagtaagatggatagaactggaggtcattatccatatagagaaatacacattgcatgtttctgacttataggtgggagctaaaaaaattgatctcatggaagtagagagcagaatggtgcttatcagaagctggaaagtgtggctggttaatgcatacaaaatacagttaaatagaataaaattctagtgtttaaaatagtacagtaggatgactacagttaatgaaaaaaagcaaaactagtagaagaaataataatcaagcagaacaaaatcaaacagacactaaaaaaatcaacaaaagttggcgttttgaaaagataaacaaaattgaaaaaccactaacgagactaagagaaaaagagtgaagacccaaataaagaaaataaaaaacaaagagccattacaacaaatactacagaaatgcaaagtaccatgtgaaactattatgaacaactatatgttaacaaattggaaaacctagaggtaatagacaaattcctgcacacagacaacctcccaaaataactacaataaatatcaaattcttcaacacccagacaccgatgaacacccataacatcaagaccacccaggaaaatatgacctcaccaaataactaaataaggtaccagacaccaatcccagaaagacagagatatatgacctttcagacagaaaattcaaaatagctgttttaaggaaactcaatgaaattcaaaataacagaaaaaattcagaatcttaccagatacatttaacaaaaagattgaaataattaaaaagaatcaagcagaaattctggagctgagaaatgcaactggcatactgatgaatgcataagagtcctttaatagcagaacacatcaaaagaagaaagaattagcgagcttgaagacaggctgcttgaaaatacatagtgagaggagacaaaaaacaattgaaaatacatagtcagaggagacaaaaaacaaaggaaaaagaataaggaatacctacaagatctaaaaaacagactcagaagggcaaatctaagagtgattcgttgtaacgaggaagtagagagaccggggtacaaagtttattcaaagggataatgtcagagaacttcctgaacctagaaaaagataccaatattcaactacaagaaggttatagaacaccaagcagatgtaatccaaggaagactacctcaagacatttactaatcaaactccaaaaggtcaaagacaaacaaaggagaaaagcagcagcagactttgtgtctggcagcagacttttcagcaaaaatcttactggccaggagagagtgacaggacatatttaaagtactgaaggaaaaaaacttttatcctaaaatagtatatccagagaaaatatccttcaaacataatgaagaaataaagactaccagacaaacaaaagctgagggatttcatcaacacaagacctgtcccataagaaatgctaaaaggagttctttaatatgaaagaataggacaataatgagtaataagaaatcatctgaaggtgtaaaattcaccagtaatagtaagtatacagaaaaacacagaatattagaacactgtaattgtggtgtgtaagctactcatatcttgagtagaaagactaaaagatgaactgattgaaaataaaaattattcacgcctgtaatcccagcattttgggaggtgaaggcgggtggatcacttgaggtgagaagtttgagaccagcctggccaacatgctaaaatcccatctctattaaaaatacaaaaaaattagccaggtgtggtggcacacacctgtgatccagactagtcgggaggctgaggcaggagaatcacttgaacccgggaggtggaggctgcagtgagccgagatcgtgccactgcactccagcccgggcaacggagtgagactctgtctcaaaaaataaaatgaaataaaataaataaacattatgtgaggtgtgatggcttatgcctgtaatcctagaactttggaaggctgaggtgggaggattgctggaacccaggaatttgaaaccagcctgggcaacatgcaacatgaaaccagcctgggcaacaggcaaaaccctttctctacaaaaaaaaaatacaaaaaaatttagccatgtgtggtggctacaagcagtgggacatgcttgtagtcccagctgcttgggaggctgatgtgagatcacctgagccagaaggtggaagttgtagtaagctgagattgtgccactgccctccagcctgggtgacagagtgagtccctgtctcaagaaaaaaaaaattacaactttttgagagacaatacagtaagatacaaatagaaacaaaaagttgaaaagtgagggacaaagttagagtctttattagttttttatttgcttgtttggtatctgtttttgcaatcactgttgtcatcagtttaaaatagtgggttataagatagtatttatacctcatagtaccctcaaaaataaaaaatcatacaacagatacgcaaaaaaataaaaagcaagaaattaaaacataccactaaagaaatcaccttctctaaaatgaagatatgaaggaaggaaggaagagaagtccacaaaacaaccagaaaacaaataacaaaatggcagaattaagtctttacttgtaataatcccattgaatgtaaatggaataaactctccaatcaaaagacagagagtggctgaatagattaaaaaagaagactcaacaggagttccaagatggcggaataggaacagctccagtctacagcttccagcgtgcttgatggagaagatgggtgatttctgcatttccaactgaggtacctggttcatctcaatgggactggttggacagtgggtgcagcccacggagggtgagccgaagcagggtggggcatcacctcacctgggaagcgcaatgagtcgggggatttccctttcctagccaagggaagccgtgacagactacctggaaacacgggacactccccacccaaatactgtgcttttcccaaggtcttagcaaccggcagactaggtgattctctcctgtgcctggctcggcaggtcccacgcccacagagccttgctcactgctagcccagcagtctgagatggatctgccaggcagcagcctgactcggggaggggcatccgccattgctgaggcttgagtaggtaaacaaagctgcccagaagttcaaaatgggcggagcccaccgcagctcaacaaggcctaccgcctcagtagtctccacctctgtgggcagggcatagctgaacaaaaggcagcagacaatttctgcagacttaaacgaccctgtctaacagctctgaagagagcagtggttctcccagcatggtgcttgagctctgagaaaagatagactgcctcctcaactgggtccctgacccccacgcagcctaactgggagacatctcccagtaggggctgactgacacctcatataggtggctgccactctgggacaaagcttccagaggaaggatcaggcagcaatatttgctgttcttcaatatttgctgttctgcagcctccactggtggtacccaggcaaacagggtctggagtggaactccagcaaactctaacagatctgcagctgagggacctgactattaaaggaaaactaacagtaaggaatagcatcaacatcaacaaaaaggtaatctacaccaaaaccccacctggaggtcaccaacatcaaagactaaaggtagataaaaccacaaagatggggagaaaccaaagcagaaaagctgaatattctaaaaatcagagcacctcctctcctccaaagaatcacagctccttgccagcaacagaacaaagctggacagagaatgactttgacaagttgacagaagtaggcttcagaaggtcggtaataacaaacttctcctagctgaaggaggatgtttgaactcatagcaaggaagctaaaaaccttgaagaaagattagaagaatggctaactataataaacagtgtagagaagaacttcaatgacctgatggagctgaaaaccatggcatgagaacttcgtgacacatgcatgagcttaaatagctgattcgatcaagtggaagaaagggtatcagtgattgaagatcaaatgaatgaaataaagcgagaagagaagtttagagaaaaaagagtaaaaagaaacgaacaaggcctccaagaaatatgacactatgtgaaaagaccaaatctacgtctgattggtgtacctgaaagtgatggggagaatggaaccaagttggaaaacactctccaggatattatccaggagaacttccccaacctggcaaggcaggccaacattcaaattcaggaaatacagagaacaccacaaagatactcctctagaagagcaaccccaagacacataattgtcagattcaccaaggttgaaatgaaggaaaaagtattaagggcagccagagagaaaggtcgagttacccacaaagggaagcccatcagactaacagcagatctctcggcagaaatcctacaagccagaagacagtgggggccattattcaacattcttcaaggaaagaattttcaacccagaatttgatatccagccaaactaagtttcataagtgaagcagaaataaaatcctttacagacaagaaaatgctgagggattacaagagctcctgaaggaagcactaaacatggaaaggaaaaactggtaccagccactgcaaaaacaggccaaattataaagaccactgatgctatgaagaaactgcatcaattaatgggcaaaataaacagtgaacatcataatgacaggatcaaattcacacataacaatattaaccttaaatataaatgggctaaatgccccaattaaaagacacagactggcaaattggtgtgctgtatttaggagacccatctcacgtgcaaagatgcacataggctcaaaataaaggaatggaggaagatctaccaagcaaatggaaagcaaaaaaaagcgggggttgccatcctagtctctgataaaacagactttaaagcaacaaagatcaaaagagacaaagaaggccattacataatggtaaagggatcaatgcaacaagaagagctaactatcttaaatatatatgcacccaatacaggaggacccagattcataaagcaagttcttagatacctacaaagagacttagactcccacacaataataatgggagactttaacacccaactgtcaatattagacagatcaacgagaaaaaaggttaacaaggatatccaggacctgaactcagctctgcaataagcagacctaatagacatctacagaactctccaccccaaatcaacagaatatacattcttctcagcaccacatagcccttattctaaaattgaccacataattggaagtaaagcactcctcagcaaatgtaaaataacagaaatcacaacaaactgtctctcagaccacagtgcaatcaaattagaactcaggattaagaaactcactcaaaaccgcacaactacatagaaactgaacaacttgctcctgaatgactactgggtaaataaaaaaatgaaggcagaaataaagatgttctttgaaaccaatgagaacaaagacacaacataccagaatccctgggacacatttaaagcagtgtgtagagggaaatttatagcactaaatgcccacaagagaaagcaggaaagatctaaaattgacaccctaacatcacaattaaaagaactagagaagcaagagcaaacaaattcaaaagctagcagaaggtgagaaataactaagatcagagcagaactgaaggagatagacacaaaaacccttcaaaaaatcaatgaatccaggagatggttttttgaaaagatcaacaaaattgatagaccactagcaagactaataaagaagaaaagacagaagaatcaaatagatgccataaaaaatgataaaggggatatcaccaccaatcccacagaaatacaaactaccttcagagaatactataaacacctctatgcagataaactagaaaatacagaagaaatgcatacattcctggacacgtacttacataattactacctggagactttaacaatatactctcccaagactaaaccaggaagaagttgaatccctgaatagaccaataacaggctctgaaattgaggcaataattaatagcttaccaaccaaaagaagtccaggaccagatggattcacagctgaattctaccagaggtacaaagaggagctggtaccattccttctgaaactattccaatcaatagaaaaagagggaatcctccctaacgcattttatgaggccaacatcatcctgataccaaagactggcagagacacaaccagataattttagaccaatatccctgatgaacgtcgatgcgaaaatcctcagtaaaatactggcaaactgaatccagcagcatatcaaaaagcttatccaccatgatcaagttggcttcatccctgggatgcaagtctggttcaacgtacacaaatcaataaacgtaatccatcacataaacagaaccaacaacaaaaaccacatgattatctcaatagatgcagagaaggccttcaacaaaattcaacagcccttcatgctaaaaactctcaatacactaggtattgacagaacatatctcaaaataataagaactatttatgacaaacccacagccagtatcatactgaatgggcaaaaactggaagcattccctttgaaaactggcacaagacaaggatgccctctctcaccactcctattcaacatagtgttggaagttctggccagggcaatgaggcaagagaaagaaataaagagtattcagttaggaaaagaggaagtcaaattgtccctgtttgcagatgacatgattgtatatttaaaaccctatcgtctcagccccaaatttccttaagctgataagcaacttcagcaaagtctcaggatacaaaatcaatgtgcaaaaatcacaagcattcctatacaccattaacagacacacacagagccaaatcatgagtgaactcccattcacaatagctacaaagagaataaaatacctaggaattcaacttacaagggatgtgaaggacatcttcaagaagaactacaaaccactgctcaacgaaataaaagaggacacaaacaaatggaagaatattccatgctcatggataggaagaatcaatatcgtgaaaatggacacactgcccaaagtaatttatagattcaatgccattcccatcaagctaccaatgactttcttcacagaattggaaaaaactactttaaagttcatatggaaccaaaaaagagcccacattgccaagacaatcctaagccaaaagaacaaacctggaggcatcatgctacctgacttcaaactatactacaatgttgggtacaagccccccaaaatctggccataaactggccccaaaactggctataatcaaaatctctgcagcactgtgacatgttcatgatggccataacgcccatgctggaaggttgtgggtttactggaatgagggcaaggaacacctggcccgcccagggcagaaaactgttcaaaggcattcttaagccacaaacaatagcatgagcgatctgtgctttaaggacatgctcctgctgcagttaactagcccaacctattcctttaattcggcccattccttcatttcccataagggatatttttagttaatttaatatctatagaaacaatgctaatgactggcttactgttaataaatacgtaggtaaatctctgttcggggctctcagctctgaaagctgtgagacccctgatttcccacttcacacctctatattcctgtgtgtgtctttaattcctctagtgcggctgggttagggtctccctgaccaagatggtctcagcactaaaaggctacagtaaccaaaacagcatggtactggtaccaaaacagatacatagaccaatagaacagaacagaggcttcagaaataatgccacacatctacaaccatctgatctttaacaaacctgacaaaaacgagaaatggggaaaggattccctatttaataaatggtgctgggaaaactggctagccatatatagaaagctaaaactggatcccttccttacaccttatacaaaaattaattcaagatggattaaagacttaaatgttagacctaaaaccatagaaaccctagaagaaaaccctaggcaataccattcaggacataggcatgggcaaggacttcatgactaaaacaccaaaagcaatggcaacaaaagccagaatagacaaatgggatctaattaaactaaagagcttctgcatggcaaaagaaactaccatcatagtcaacagtcaacctacagaatgggagaaaacttctgcaatctacccatctgacaaagggctaatatccagaatctacaaagaacttaagcaaagttacaagaaaaaaacaaccccatcaaaaggtggggaaaaggatatgaacagaaacttctcaaaagaagacatttatgtggccaacaaacatatgaaaaaatgctcatcatcactgatcattagagaaatgcaaatcaaagccacaatgagataccatttcacaccagttagaatggcaatcattaaaaagtgaagaaacaacaggtgctggagaggatgtggagaaataggaacgcttttacactgttggtgggagtgtaaattggttcaaccattgtggaagacagtgtggcaattcctcaaggatctagaactataattaccatttgacccagaaatcccattactgggtatacacccaaaggattataaatcatgctcctttaagacacatgcacatgtatgtttatggtggcactattcacaacagcaaagacttggaaccaacccaaatgccatcaatgatagactggattaagaaaatgtggcacatatacaccatggaatactacgcagccataagaaaggatgagttcatgtcctttgcagggacatggatgaagctggaaaccatcattctcagcaaactatcacaaggacagaaaaccaaacaccacatgttctcactcataggtgggaactgaacaatgagattactttgacacagggcagggaacatcacacactggggcatgttggggggttggggcctggcagagggatagcattacaagaaatacctaatgtaaatgatgagttgattggtgcagcaaaccaacatggcacatgtatacctatgtatcaaacctgcacgttgtgcacatgtaccctagaacttgaagcataatcaaaaaaaaaaaagaagactcaatgaacagttgcctacaagaaacagacttcacctataaagacacacacagaccaaaaataaagggatgaataaagatattctatgccaatagaaaccaaaaaagggcagaagtaactatacttacatgagacaaaatagatttcaagacaagaactataaaaagatacaaataacgtcattatataattataaaatggtcaattcagcaagaggatataacagttataaatatatatgcatccaatactggagtacccatatatgtacaggaaatattattagagtcaaagtgagagatagcccccaatacaataatacctggagactttaacactatactctcagcattgaacagatcatccaggcagaaaatcgacatagaaacatcagacttagctgactctagtctagtagcactgcctaggggtcatcacagctctgcaaggagcagcaaaagaaaaataaaaaaaagaaaagaaacatcagacttcatctgtattgtagaccaaatggacctaatcgatatctacagaacatttcatctaacagctgcagaatacggcttcttctcctcagtacatgaatcattctcaaggatagaacatatgttagatcacaaaacaagtcttaaaacattcaaaaaacctgaaattataccaagtttcttctctgaccacaatggaagaaaactagacatcaataacaagaggaatttttggaaactatacaaacacatggaaattaaacaatatgcttctgaataaacagtgggtcaatgaagaaattaagaaggaaattgaaaaaaattttgaaacaaatgataatggaaacacaatataccaatacctctgggatacagcaaaagcagtactaagacggaagtttatagctatcggtccctacaccaaaaaagaggaaaaacttcaagtagacaatctaatgatccatcttaaagaactacaaaagcaagagcaaagtaagcccaaaagtagtagaagaaaagaaataataaagatgagtgcagaaataaataaaatagaaacaaagaatacaaaagataaatgaaatcaaaagttggctttttgaaaagatgaacaaaatcaacaaacctttatccagactaagaaaaagagagaagacccaagcaaacaaaatcagagatgaaaaaggaggaattataatacaactgatactgcagaaattaaaaggatctttagaagctactatgagcagctgtatttcaatagattggaaaacttagaagaaatggataaatttctagacatatataactgtttggaggttcctccagaaactaaaaatatagctaccatatgatccagcaatcccactgctgggtatatatccaaaagaaaggaaatcagtatatcaaacagatatctgcagttccatgtttattgcagcactatttacaacagcgaagatttagaagcaacctaaatgtccatcaacagttgaatggataaagaaaatgtgggacatatacacaatggagtactattcagccacaaaaaaagaatgagatcctgtcagtttcatgtatggaactggaggtcattatattaagtgatataagacaggcacagaaagacaaatctcacatgttctcacttatttgtgggagttaacaattaaaataactgaactcatggtgataaagagagcagaatggtagttactagaggctaggaagggtggtggtggtgggtggtgggggatggttaatgagtacaaaaatacagttagacagaatgtatatgatccagtatttgatagcacaactaggtgactagagttaagtcaagaataatatattgtgcatttaaaaataactaaaatagtagaattggactgtttgtaatacaaagaaaggataaatgctttatgtgacccatttaccctcatgtgattactatgcattgcatatctgtatcaaaatacctcatgtacccaataaatatatacacctactatgtacccacaatagttaataagacattaagaaaaaagagcaattgactgagaggaaaggcaaagatgacccaaaatatacaaagtggaaattcccaaagactggagaaaaaaaaacagaatactagatgcccggtatggtggcacatgcctataatcccagccctttggaggctgaggcaggcggatcacttgaggccatgagttcaagaccagcctgggaaacatagcaagactccattgctgttagaaaaaagaaagaaagggagaaaaggagaaaaggagaaagggagaaagagagaaagtgcggggcagggggagagaaggaaggaaggaaggaaggagagaaagaaggggggaggggagaaggaggggagagggagggaagaggaggagaaaggagaggaggggaggggaggggagggaagaagacaggcaataattcaagagtactgtcctaaaattgagaggataaaaaaagactcctaaaactgacaggggaaaaaaagaccggaagctacatattaaaaagatatactatgatgaagactacaaaactgatgaaaaaattaaagaacaataaagagatatctcaaacttatggacaggaagcttcaatatcattaagatgtcagtttttttccaacttgatctttggatttaacataatcccagccaacccagcaagctcttttgtggatacagacataataactctaaagtttatatggatatacaaaagacccagaatagccaatacataattgaaggagaacaaagttgggggactgacactatgtgacttcaagaaatactataaagctacagtaatcaggatactggggtactggcaaaagaacaggaaaaaagttgaatggaatggatacagagttcagaaatggccccatacagatatagtcaactgatctttggcaaaggagcaaagttaattcatcgaagaaggaatagtatttacaataagtggtgctaaaaaaacactgtacatctacttacgaaaaaaatgtatctagacacagaccttataactcttcaaaaatatttactccaaataaatcacataactaaatataaaatgcaaaactaggccgggtgcagtggctcacaccagtaatcccagcactttgggaggctgaagcggatggttcacttgacctcagaagtttgagaccagcctaagcaacacggagaaacaccatctctacaaaacatacaaaaattagccaggcacaatgatgcacactggtggtcccagctacttggggtttgaggtgggaggatcacatgggcaaaccctctctctactaaaaatacaaaaattagccaggcatggtggtgcatacctgttgtcctagctattcaggaagttaaggtggaaggatcacctgggcccagggaggttgaggctgcagtgagccatgttgcaacactgcactccagcctgggcaacacagtgagaccccatctcaaaaaaaaaaaaaaaaagacaatgtcaagagaacatgaagaaaagccacagactaggagaaaatacaggttgactatctctaatccaaaatgctccaaaatatgaaccttttggaacattgttataatgcccaaaggaatgttcattggagcatttcagattttggatttacggattagagatactcaactggtataatgcaaacagtccaaaatctgaaaaaaaaaacccaatccaaaacacttctgatcccaagcatttcagataagagatactcaatccgtatttgcaaaagacatatttgataaaggaccattaaccaaaatatactaagaattcttaaactcaacaataagaaaataaagtacccaatttaaaaatgggtgaaagatctcaacaggcaactcactaaggtatacaggtggcaaagcagcatatagtaagaatcatatgaaaagaggttcaacatcatatgttattaggagattgcaaataaaaacaacaacaagataccactacacagcaactaaaataaccaaaatccaaaacactgacaacaccaaatgctggagaggacatggagtaaaaggaactctcattcatacactgcaaaatggtacagacactttgggagactggtggtttcttacaaaactaaacatactcttactagacaatccagcaactgtattcctctgtattcacccaaatgaattgaaaacttaagtccacacaaaaacctgctcatagatgtttatatcatctttattcataattgctatcacttggaagcaatcacgatgtctttcagtacatcttgaaagtgaataaataaactgtggcacatccatacaatgtaatattctgcgctaaaaagtaatgagctattgagacacaaaaagattacagaggaaccttaagtgtatattactaagtgaaaccatccaatctgaaaagagtacatactgtatgagtccaattacatgacattctggaaaagacaaaactatggagatagtaaaataatcagtggttgccagggtttggaagaaagggagggataatataagcagagcacaggggattcttggggcagcaaattcttgtgtaataatagtggttacatagcattatacatttgtcaaaacccagggcaattaaagcaccaagagtaaattttaatgtaaactatacactttggtgataatgatgtgtcaacattggtctattgattaaaacaaacgtacctctctggtgtgggctattgatggtgggggaggctgtgtgtgtatgggggaagggcatatacaggaactctgtacttttcactcaattttgctacgtgtattagtccgttttcatgctgctgataaggacatgcctgaggctgggaaattcataaaagaaagcggtacaactgaactcacagttccacatggctggggaggcgtcacgatcatggcagaaggcaaggaggagcaagtcacatcttacatggatggtggcaggttaaaaaaaaaaaaagcttgtgcagagaaactctcattttttaaaaaccatcagatctcgtgagatccattcactattacgagaatatcatgggaaagacctgcccccataattcaggcatctcccaccaggttcctctcataacacgtgggaatcatgggagctataagatgagatttgggtggggacacagagccaaaccatatcactatgtatccaaaactcctataagaaaaggtctattaaacaaacaaaaaaaacccactatgtactgtactagaaaaataaactcaatgccaaaatatattttaagaaaatgattggactttaagtaaaaagaaagatatactctgagcatccaagcaaaaagaccaaatcacttataaggtaaagaaaataaaactgccatcagactttctgcagcaatgttttatgccagaatataattaaactatatattaaagacagtcaaggaaaaaaaagtaagccaaggattttacatgcagccaaatcgaccctcacaaataaagtcataagacaaactgttatgaaaatggaaaatctatgagtgtagtgttcacacaagtccttcctaaggaatctattacaaaaagagtttcaagcaatcagaatgactaaggagacactgacataagaattggaagactaaaataaagaacaccaaggatcttttatgtttctcatttaatacacaaaacaagccttgatagtagtgtttccattctacacatggaggaaatgaatgccaaagtcagaggaacttatccattgttgctgagcaagtaataaagccaggattggaaccaaagcccattctctttctaccacatgaagctacctccacatacacatgagctaaacctttgtctttgcatatactagaatagcatactgcctggaatttcattctcccccttatctaccttatgagttatttgaaaaacaatctttgatacacccaaaaattgcttattctctgtggctttcccttacctaaaagggccatatatattgtcattaataaaaccgtatggtactgataaagaaaagccacctcatctgtggtcccaaaactgcttattgtcttgtggctctcccttacccaaaagggccatatgtgttatcattaataaaggcatatagtactgataaagtaaagctacctcagctgtggccgcagagcatttcacaaaaaacatctgtaacacagattttgccacatgtgatttcgatgatggtaaaaactgtcacttctttggcttaaaatcccaatacagagcatattcttcccagtaaatgtatttgggagaaaaagaagaggggagataacaggtctgggatgtctttcttgactatacaagataaagttaattacctaaatatctctgcattaattctgaactttgtgggtactttttattcttgtccttttcacgcaatgttattatttgttttcatttttgtctgtcctctgagagcaagaatgatctttttttcctttatagcttaccatctaacatataatagtgaacacaactaagaagtgttcaataaatagttggtgactgaatgaagagaaatcataagttatttctcagttccaattctgtgcaaatggattatgatgaatacgaagaatgaaagcccaatttttatgcggtttaagtattactgtacaccaaattgcatatatttaattaataaaacgacatcaaggaatcagaatctaatattttaaaagtaatagtgttaatgagcatcagcatattatagagcttttagactacaaaaaaaatctgaatttttttctcatttttttccagagagttttgcactgcagagtaaaattattattattatttaaaaaaatgttagagcctgaaggcatttttgtcttgaataaagcctggaacattttgaaaaagttactagtatttttaattagtatttggcatacaactgcaaaatttccttatatgagaatgtgaacaaattaattacaaacatatacactttttgccttttttgcagatgactgtatttctcaattcaaattgttttctccctttaatattaaagaaaataacagaattattagcagcctacttttgccatttcagtaacatgtgtataggttcgtttcactggctaattccattattgaacatatcagcagtgtcatctcctaggttatttttccaccagctctggatatgagtgtcactagaagctttttaaggggagacagagaaaaagagtgagagagatagagaaggaaaaagaacacaaaagtgcaacacacactcctgcctagacacaacttctaaaaagaggaaaagtacactccacttcctcatcatttaaacaagctgtttaatctgaaaatacctgtttcatacatagccactcttcttgatgcatagctgtaataccaaaggccacaaaacttatggatcaggaatatttcctcctgcctcatgacaactctccttccccagtcctagaattaataatgtctgtcatacctactaaaataccttttagtcaatctcattcttgaatccatatcaaaacagacacaattcatctcagtgcatttctcctatatctgttttcatgtaaaacatcattctgacttttccaactccacccatacacacttcattttccttttagatcccatccaggtctatcaggtcaaaactcaagactaccatttggacaatccccctagaaaacacaatcattctcaatctaattaaaaaattattataagagaaagataattaaaaataattcacttaaaatggaaacatcttaaaatacataattagatttttaataatattacttctagtatagaaaaactaccagtttctccttaccacttctaatagttgtattttctaatagttctgtctgaagttgtagttcagcttctccaagtatctttagaacagaatctgtcggacttttcccccaggctcttcttggagatccattaggacctaatttaataacttctcccactgtatgtcctataagaaaaatatacaaagaaacaattttcaataacagtataataatactgcatggtaaggcagattttgagtcttttatccaattgagtggttcatgagaaaaaaaggttatatcacaaagactttcagggaaagaatgatgaataatggcaagaacagaagcaaatgaaactagcaataaaaatatatctacaattgccttgtagaatatgaattaaattctagttttggggaatataaaaataggaaaaaaccataaattaatacagactgagtatctcttatctgaaatgcttggggccagaagtgttttggattttgaatttttttcagactttgaaatatgtgcatatacataacgagaatcttgttgatgggaccaaagtctaaacatgaaattcatttgtttgttttttaagagatagagtctcactatgttgcccaggctagtcttggactcctgggctcaagtgaccctcccaccttggcttcccaaagtgctgggattataggtgtgaaccaccacaaagggcctcatttatgttttacatccatcttatacacatagacttgaggtaattttatataatattttaaacaattttgtgaacaaaacgaagttcatatacatagaactatcagaaagcaatagtgtcactgtcttggccacccatgtgggccctctatggttgtttggcatcaccatcattcctgactgtgagtttatatgctgctaataagcaatcattttcttacacttgttcacacaaaaatacttcgtagttaaaaaaaaagagagacataccattacagtgaaaaaatgtgtttaagataactaagcagcacagtattatcaccagaatacctgagagctgttaagcaaccgcaggctttcagtctccacccacgaaactggattttgattaaaaggttactctatgctgtctttcattttatgggcaaaaagaaatatcagaagcagctgagggatcagaaagggatctgaagggatgagaaggtattctatcagatagctttttaaaatggctggagggtctttttgtccttggggatgctgaataaaccatgtgttgtgtaccttcactttgactttgacacatcacatggggtcagatgtgggggtgtcacactggtactcaaaagtttcagattttggggcattttggatttcagattttggattagaaatgctcaacctgtattatgtttctataaaatctttatgtgaaaaaatagaaaaaactaagataagtaaatacaattggggggaatataaaaatagaagaaacaaattagtatttcatttctatatattaaacagaaaaaatagaaaacaaatcttaaaataaacatacatatggattaaaaagcagagaaaagtatttctaagaaaatttgtcctgctttatttatcataagtaggcaaataactgctacttccttattgacaataataatttggggtaaaccattttaataacatttatcaaagcaatatataaaaattatatactgaagtttgagtctttagaatatttggtaataatatatgaagtatacaggtacctagtagtaacatacaggatataatattatgtattatgaggcataaggtatatagacattcaatggtaacctaatacatattgatacagttaatgtaccagttccatgaaagtacatgcaaattagcagataataattagtttcatacagccaaaatgattaccaagaggaatttcttaaaggatggttaaaatagagtagagaacccagaaatagacccataacttacagtcatttgatgtttgacaaatatgccaaagaaattcaaaaggggaaaaagttctaacaaacaaaactgggataactaaatgttcataagagaaaccctcctgtcccccccaccactggaatttaaccccttcaatgcagggagggaaaacagaggtggagtcaatggtctctctgagctgaggaggtggaaatgggagtctagggaggccaaagtggctagtgtttgcaagataggagtactgaagtaatacgtttcacagagagagaactcaggaaaattgtaaaaagcccctttgagtctttacttgagtactgatcagcatatcagtacataatgtataaagaaattttagagaaagtttagagaaaagaccactcaaaagaagcagaggtaacaatacttcgagttcacacagtgccagaaagagttcctattcccatcagccaaaaaagactgatttataattcacaaggcacaaggcagattattcagaaaggttgttgatgcagaaaaggtaaaagattagcagtacgctaatgcacagtaatactaataaatactaataatatagattgctgctttgttccaactaacaaagcttaaaagcaagacttgaaagagccaagctatgcacaggtaactaaattgtgtccaagaataaaggtcaagaatatttatagaaatacaaaaatacatagcacaaatattaaaattcacaacatttggacacccccaaaaaattatcaagcatgcacagaaacagaatattaactataaaaaaggaagaaaaaaatcaatgaatccaatccaactctataatgacagagatgatgtaactagtagacaaggacatttataactgtcattgtaactgaattccatatgttcaacaagctagagagaagactgaccgtgatagaggtaaagaaaacattaataagatccacactgaacttgtcctaatgaagttcatataaatgaacctgtccattgaactcgtccattcatactgaagacagaaaaaaaaatagaataaataatggccacgagtttttcaagtttgatgaaaactataaactcataaatccaagatgctcaacaaaacccaagcaaaagaaacatgacgaaagtgacatcaaggcacatcacaatcaaattcactgaaaccaaggctacagggaaaaatctgaaaaggagtcagagaaaaaagacacagaggaataaaactaaaaatgagggtaacagaagacctcatcacaagtaatgtgcataagatgacagtggagcagcatcattaaagtactaaaagaaaaaaatttcaatttagaattctatgtctcagaaaaaatatctttgcaaaaggaaggctaaataaaataaaaataaaaacttttacaaacatttgtatgtctttaaaataaaaacttttacagacatacaaatgttgaaagaatcaccagcaggactgtactacaaaaaatcttaaaggaagtccttcaggcagaagaaaaatgatacaaaatagatatcttctacacaaaagaaatgaaaactacatgggtagacacaaaatagttttttctcttattatttaaatctttttaaagaataaatgactctgctgtattatgggatttatagcataaaaaaaaaatagcaccaaaggttgggagggaacaaatgtaagtacaggtgaccctcaaacaaagttctgagatgccagggttcacttataaacaaattttcttccacctatgccacccctcagacgccaagaccaaccccccaacttcctcctcttcagcctactcaatgtgaagatgatgcggatgaaggcttttatgatgatccatttccacttaatagtaaatatattttctcattcttatcattctcttagtaacattttcttttctcttgattcctattatgagaatatagtatataatacgtataacatgtaaaatatgtgttaattggctttatgttattgataaggcttctggtcaacagtaggctattactagttaaattttgggggagttaagagttacacacagatttttgactacacgggggattcaacacccccaacccccgtattattcaagggtcaactgtatattattgtaataatcttataccatatatgaagtataactcaattgaagataggctgtgctaagttaatacactgtgctacaataatacactataaactctgaagcaaacactgaaataacaatgagctatagctaataattcaacaacagaggtaaaatggaataataaaaaataaccccaaataatgcaaaacaggaggaaaaaggaaagaaagcatagatgaggcaaacaaaaaacaaatagaaaaatggtacacagacagtccctgacttatgatggttcaacttaagatttttcaactttacaatgggtttattagactgtaatcccattgtaaattgaggagcatctggatttaaatccaatcacattaataatcacattaaatgtaaatgatctaaacataccagttaaaggttatgatttttaccagttaaagatttttcaactttacaatgggtttattagactgcaatcccattgtaaattgaggagctctggatttaaatccaatcacattaataatcacattaaatgtaaatgatctaaacataccagttaaaagttattttaaaggattaaaaatgaatttaacaatatgctgcccataagaaacccatgttaaatataaagacacatacagattaagaggaaaaaaaaggataaagatataccaggttaacactgagcaaaacaaagtaggagtgactatatcaatatcaaacaaagaaaacttttaataaagcaaagatttttttaaaaagaacaagctattaataattacaacacagatgaatctcaaaaatcattatgctttcagccagaggtgagagattagggaaaaataatcattatgcttgagtgaaagaagccagacataaaagaatacaaacgattagagtctgtttatatgatattctagaacaggaacatttaatctaaggtagaaaaaaaattcagaaaaagttgcccctgggaggataagaacagagaacgattaggcaggggcaaactttctggggtgatgttaatgttctgtatcttgatgggggttcttattttgtagctcccagcatttgttaaaaaccagtaaatatatatttgtaatgtgtgcatttcattgcatgtaaatttaacataaatgaaaaaacaaacattgaactctaataaataattacatgctgtgaaatacttagggcaaggtataccaatgtctgcaatttactctgaattgcatgaaacaatgacaaaccaattgatggttttgctatcaggatgatgctggtctcataaaattagttagggaggagtccctctttttctgttgtttggaatagtttcagaaggaatggtaccagctcctctgtacctctggtagaattcggctgtgaatctgtctggtcctgggctttttttggttggtaggctattaattactgcctgaatttcagaacttgttattggtctattttcagggattcgacttcttcctagtttagtcttgggagggtgtatatgtccaggaatgtatctatttcttctagatttactagtttatttgcatagaggtgtttatagtattctctgatggtagtctgtatttctgtgggatcagtggtgatatcccctttatcattttttattgtgtctatttgattcttcttttcttctttattagtctggctagccgtctatctattttgttaatcttttcaaaaaaccagctcctggattcactgatttttttttgaagggcttttcatgtctctatcttctttcagttctgctctgatcttagttatttcttgtcttctgctagcttttgaatttgtttgctcttgcttctctagttcttttaattgtgatattagggtgtcaattttaggtctttcccattttctcctgtgggcatttagtgctataaatttccctctaaacactgctttagctgtgtcccagagattctggtacagtgtgtctttattctcattggtttcaaagaacttatttatttctgccttaatttcattatttacccagtagtcattcaggagcaggttgttcagtttccatgtagttgtgaggttttgagggagtttcttaatcctcagttctaatttgattgcactgtggtctgagagaccgtttgttatgatttccattcttttgcatttgctgaggagtgttttacttccaattatgtggtcaattttagaataagtgctatgtggtgctgagaagaatatacattctgttaatttggggtggagagttctgtagatgtctattaggtctgcttggtgcagagctgagttcaagtcctgaatatccttgttaattttctgtcttgttgatatgtctaatattgacagtggggtgttaaatctcccactattattatgtgggagtctaagtctccttgtaggtctctaagaacttgctttatgaatctgggtgctcttgtattgggtgcatatatatttaggatagttagagcttctcgttgcattgatccctttaccattatgtaatgccattctttgtcttttttgatctttgttgctttaaagtctgttttatcagagactaggattgcaacccctgctttttttttttttttttgcttttcatttgcttggtaaatattcctccatcgctttattttgagcctatgtgtgtccttgaatatgaaatgggtctccttaatacagcacactgatgagtcttgactctttatccaatttgccagtctgggtcttttaattggggcatttagcccatttacatttaaggttaatattgatatgtgtgaatttgatcctgtcatatgatgctagctggttactctgcccattagttagatgcagtttcttcatagtgtcaatggtctttacattttggtatgcttttgcagcggctggtactggtttttcctttccaagtttagtgcttccttcatgagctcttataaggcaggcctggtggtaacaaaatcccttagcatttgcttgtctgtaaaggattttttcacttatgaagcttagtttgactgcatatgaaattctgggttgaaattcttttctttaagaatgttgaatattggcccccactctattctggcttgtagggtttttgcagagagatctgctgttagttcaatgggcgtccctttgggggtaatccaacctttctctttggctgcccttaacattttttccttcatttcaaccttgggaatctgacgattatgtgtcttggggttgctcttcgcaaggagtatctttgtggcgttctctgtatttcctgaatttgaatgttggtctgccttgctaggttggggaagttctcctggataataccttcaagtgtgttttccaacttggttccattctccccgtcactttcaggtacaccaatcaaacatagatttggtcttttcacatagtcccatatttctcgaagggtctgttgtttgttccttttcattcttttttctctaatcttgtcttcactctttatttcattaggttgatcttcaatccctgatatcctttattccacttgattgatttggctattgatacttgtgtatgcttcacaaagttctcttgctgtgtttttcagctccatcaggtaatttatgttgttctcataactggttattctagtgatagttcctgtaactttttatcaaggttcttagcttccttgcattgggttaaaacacactcctttagcttggagagtttgttattacccaccttctgaagcctacttctgtcaattcatcaaactcattctccgtccagttttgttcccttactggcaaggagttgtgatactttggaggagaagaggcattctggttttgggaattttcagcctttttgcgttggtttttcctcatcttcgtgaatttatctacctttggtctttgatgttggtgacctttggatggggtttttgcttgggtgtcctttttgttgatgttgatgctattgctttctggttgttagttttccttctaacagtcaggcccctcttctgcaggtctgctggaatttactgaagttccattccagaccctgtttgcctgggtatctccagtggaggctgcagaacagcaaatattgctgcctgatccttcctctggaagcttcgtcgcagagaggcacccgccagatgccagctgaagttctcctgtttgaggtgtctgtcgtcccctgctgggaggtgtctcccagtcaggaggcacgggggtcaagaatccactggaagaggcagtctgtcccttagcagatcttgagcgctgtggtgagagatctgttcctctcttcagagccagcaggcaggaaagtttaagtctgttgaagctgtgcccacagctgccccttcccccaggtgctctgtcccagggacatgggagttttttctataagctcctgactggggctgctacctttctttcagagatgccctgcccagagaggaggaatctagagatgcctctctagattctggctacagcggctttgccatgctgtgttgggttctgcacccagttcaaactttctgtcagctttgtttacaaagcctcagtaatggcagatgcccctccccacaccaagcttgagcatcccaggtcaacttcagactgctgtgcaggcagcgagagtttcaagccagtggatcttagcttgtggggctccgtgggggtgggatccgctgagcaataccactcgggtccctggcttcagctccctttccagaggagtgaacagttctgtcttgctggcattccaggtgccactgaggtacaaaaaacaaaaaaaacaaaaaaaaacaaaaaactcctgcagccagctcggtgtctccccaaacggccatccagttttatgcttgatacccagggccctggttgtataggcacccaagggaatcttttggtctgtgggttgtgaaaaccatcggaaaagcgtagtatgtgggtcagatagcaccgtccctcacggcacagtccttcatggcttgccttggctagaggagggagttcctcaaccccttgcgcttcccaggtgaggcaacgccccaccctgcttctgctctccctctgtgggctgcacccactgtctaaccagtcccaatgagatgaactgggtaccttagttggaaatgcagaaatcacctgccttctgcattggtctcactgggaactgcagaccagagctgttcttatttggccatcctgacactttcccccaacttacttgtatctttctacctttgcctccatgcatcctttcacaatggcaatggtctattgcctcagaggtgctctcaatcatctccagccccaccatctcagagatctcacaacaccagtgtctctcctcattatttatgtttttgtcctcacattcatttatttaataactacttttcatgtataaattacatgctacatgacggagcataaacatgcagtacaaataagacaagctttatcaaaatgtttatattctaaaacagaacacaggcaaattatacttaaacaaatgaagaagataattacagtatgtgattagttctttaaaaataataaataaaagaactcagaaataaaaaatcaaatactggccgggcacagtagctcacacctgtaatcccagcactttgggagatggagggaggaggattgtatgaggccaggagttcaaaagcagcctggttaacatagtgagtccaccatctctaacaaaaaagaaaaaaaaaaaattagccgggcatggcagcacgtgcctgtagttccagctactctggaggctgaggcaggaggatcatttgagcccagaaattttaagatacagtcagccatgactgcagcactgtattccagcctgtcttgaaaaaaaaaaaaaaaactgcatattcttacagaattctaagtgggagctaaacaatgggtaaacatggacatggaggcaaataatagacactggggactccaaaaggggagaggctgggcaggggtgagggttgaaaaattatctattggggtaccaataccaattacctattggggtaccatgttcactattttgagtggtaggtacactagaaacccaatcctcaccataatgcaatatatacatgtaacaaacctgcacatgtacaccctgaatctatagaaataaaatagatttaaataaataaatatttaaagtacagaaataatattcaatgatttgaaaataagagaagggtcaggcatggtggctcatgcctgtaatcccagcactttggggagccaaagtgggtgggtcacttgaggccaggagtttgagaccagcctgggcaacatagcaaaacaccatctctccaaaaaatacgaaagagagagagagagaggtctactattaatagaggggagaaaagtgaagaaagtgcttcaagaagagtgtgtatgtgtgagcacacgtgcgtgtgggtatggacaataatccaggatgtcgaagctgtaaatacataaaatagggcctttaaaacttaccgacatgaaggtctatagtgaccatgaaaagaattgtaatggagtggtagaggaaaaagtctggttgaagtagattaagggagaataaaggagaggaactagaattgtaaacagagaacacttttgaagaattctgatataaagaggacttttagaaatggggtgatagctaaagaacagggacagaaaaaaaaagagaagcagccacattaaggacttgggaaagagggaaggggaagagtacgatggaaaagaaagagcttggcatgttttaagaagtgaaaggtgagaagtagttctagtgaactagttagaaggaaatggatacaatgagcaggcaacgcataaaccaagagagaggagagacttgaatcattaaaagaactttggacttttattctagttgcaatgaaaaccaattaggttttaaaatgagacagtgatgtgatatactttggttttctaatcagcataaaatattttcaagtctctttttacacaaggttacaatgactctacatccccaccaagtaataccatcttacctctctgttctgcttcgcagttcagcttcttgaaaaggttctaaactctctttttaaatttcctctcctattcacttcctaattcttggattctatttctgtctctagcactctaatgacactgcttttaccaagctcacattgcctcttctctgacgaatccagtgtatattttttagccttgaatatgttacctctcttcctgaagtgctttcttctttctttggaacccatactacagtctcctaattttatctctgtctgttcctcattttctttgcaaaggtcttcctctgatgaactctttgaacagtttcacataaagcccctataagtctgtctcctagtatcttttaaatatctcctctttattacctttcagtaatttagttaaggtcatcattaacttctgcctagattagtgcaatagcctctaaaaactggtttcaaggatatctacttcttattaagatggtatagagtaattagagttatgctgctccctaaataaccaaaacaactggacaaaatatgagacagcagtttcaagacattgtacaacaggtaataaagaacatgggtccctgagagagggaaaaaacaaaaacaaaaacaaatgagatgatccctatgattgcccagcctttagagttttcaggctatagctaatgggtctaccacactccctgagttcaggaggtagagctgggattcctggaagaccaaagcaactagaaagagaattccagagacctgcagatggtagccctgagtatgagcagagcaaatatatgagaaaactacccaagttaggaaaaaaagcacccaaaaagattacagagaacacaagacatgaaatagtgtctattcctaccagccaaactggaaaacctcatcattccttccgtagagcactcagaagcatcttatctcctaaatgggtataattagcattagactaaacatggctctgatctcacctcacaaatattaaaaataagacatgaatgaatcaaactgagtccaagtattataacttaactgcattctagaataaatctccagaataattacaaaaataaaaaaatacctagcacccaacaaggtaaaatgcaaaatgtctgacatccaattaaaaacaaccaagcctgcaaagaagcagaagaatacaacctgtaacaaggagaaaaggcaatcaataaaatggacccaataaaattctaacatttgacacagatgtcagaataagtaaagacattaataaaattttcacaactgtattccatatgatcaaaaaagttaagtagagacatggcagatagaaaaacaactccttaaacttctggaggtgaaaactacaatatctgagatgaaaagtacattgaatagaattaatagcagattgggtatggcaggaaaaaaagactatcatctattaaagatagagcaatagaaactatccacaatgaaacacaacaagaatctaaaaaattaaagtaaaaagagcaccactgaggtatgagacagaaagtaaaactggagtccctaaaggacagaagaaggaggaggcatggaaaaaatattagaagaaatgatggctgaaagtgttccaaatgtgacaaccataaacccaaagacacaagaagctcaatgaatcccaaggacaggaagcatgaagaaaactataccaaggcactttacaatcatattgctcaaaaccagtgataaagacaaatcataaaagcagacagatagtgtccccacccaaatctcatctcaaattataaccctgtgttgagggagggaggtgactggatcatgggggctcttccaaggctgatttatggtctcttatgtattcctgcagtagtctatgattattcctagcacagtatttatcaactacaattatctctttacttgcctgcctttccactagaccttaagctccctaaggggagggactacattctaaacattattatattcccattgcttaagagtgtattacatatggtaggtacccaataaagaactgttgaataaataagcaaaataaatgctatcaagtctttgggcttttttccaatgcaagaaaaaattctacaaaaacagtctgtgaaaaaaattacttaaaatcagatttgttgatggtcagacttgcccttctagaatgtaagctccacaagagcacatatgtttctgttttgttcctatatctccaattcctagaacaatgtaagaaatatagattctcagtaattatcaccgaatatataaatcattaagtcagattttctcaatactctcgctaaatgcctaagagatgtttctgagacactaccctggttctcatcaagaattattcatagtaacagattaatttaacatggtatacagagttaaagtaatgcaatttaaatatgtatcattagttccctctctcacactatacacttttgtaataaaaatccttgctattaaggctgattagtttgattagttttctctgctcttcacatttcactgtgagagggaggcacttctattcgcccaaaaggaaaatatatagaattctttcagcttctctcaattcttctaagtgttcatttttttcagagtggttagtctataagtttacatatgtactagacctaaataggatattaatatactactatacatactttcagttgtagagaaggatgtatctagtgttaactcatccagaggaatcacaagttgacctcctgcctcccacttcttgcgatcagatgaaactgatttttctttttcatgctctttggcatcttcatgaacatttatctcaaaagtatcagagagattctgctttcctttttcatcttcttgagctttaagattttcatttaatctacgaagtatttctcgcttactctgaaagtcacgacattatatattttaatatgtatatcattaagtaaaatgattgataaactttgaaaattttacttactgaaatagcattgttggtcttttgcatctcttctgaagtttcccgggtatcagttaaactactgtcctttaaatgcagatagatacagaggaagagataattttatttttttaaatctacctttaaaaatattacatcctcgttactttttggttttcattaatttgttccttgtaaattttttattcctataaaatgttaacaaagcttccttcattatcagcaatgactaacctttaaatattattaattagacaacatagacaggggccaattctcaattatttgtcatatttttagattactgctcacataattaactatatcctcttcctctttggtacctgattttttggtaatttaagtcagaaaattagaggaaaaagtagaaattagaggaaaaagtagaaattagaggaaaattcatatactctcttaattataactagaaaaagttttgatagatgaagtaattcaaaataggctgtgttattctaaaactgtctttatgtttcatgtatatatatccttgttaagccatagtactaaatgtaattgagaagtggctttcctccctaaacaaagagtgtaacaaaaattagttctgagtcatttgtactacaaatgacataaatgttatctcctaattagcattgtcaaagcaatccagactatctaaaattaaaaaacatacgaaaagaagaaattagcagttacgaaagctatgaaagcaaaggcatgtagaagattcaaagaacaattttctaagttttaagtaagtgacatttaccaacacaacacagaaagaaaaccgttcagttatatggattacctcgaattttgtaatacttaaaaaaaattaaaaatttggtggtcagtttcaaagtaatatatgaagcaatgagacaaagaacattttacccagtaaagtagtcaggaattagcagtcctacaaccagagagatgaacagctattgagatgtgagactgggtaccaaggagggaccacacagtggtatctaaagttggagtaacaacgtggcacacgcaaagtcgttatcagaaagaaaaagtgactaagcctacttgaagaacaatagtttcttacatgaagttcttgagaatgatcaagaaacttatattttcctactgagttttattttcaaaatcaacccaaaggctataaaaaaaaacagctagtgtaccaattttgtctgcaaatatttactgaaactaaacaaataaaaagcacagacatccattaccaggaaaggggaaaatgaagttattatgttatctgattcagtagacttttctcctcctgtctgttgaattctaggccgcagctccacactatgagcccacttctcttaacccctgaacagtcttcacacttcagacagatacctgaaatatacttctaagtttaagctttttatttgtctatgtttctttgttttactatctgtagggcatgacagagattcagaagtagaaggtaaaaggaataactgatgaattaactagttctactgagtcctctaacatttgccatgtcacaaaatttgaataaatgtaaatatgtgttggacctaatacctagagctactttagcaccaaagagacattattctttttaaagtgaacatttgttaatcatgagggttgggtagaaaaatgtttatagtattattttcagtacatttctctgtatattttattttttcaatattcttttaaagtaatataagagttattgtgatatattttcatctaccacgtggtcctagatataaaacttataaacaatgaggctccagtattctgagtaaactaaaatcccttaaaaagtaatttttttccttagaaaaacctgaaagggacattagggattaatgtgatttcattaaatttaatttccttttaaataatcttttgactttgaggagttctgaatcttaggaaacttaccacgccaacttctttcaaagctgaagttacagaaataacagatctcatctgttgctttgatggagagccacctgtttcatgctgtcccaaaggtggagaaacatcagaactcttaactcctttagccaccaactataaaaaaggattttattaaatacattagggattttatatttgtatgaagaaataaaatggtacctaccagatcactatttatccactctatccacaagtagtttttttcattcctgaattatctgttgagcaaggcattatgatgctacatgctggggatacagcagtgactagagaaaaaaatctctggtctcagatgtacacatagtcatgtcacatagtcctaaataacccgctttcattgcattatcaatgtttcatgaaatgatcctgaaaaactgtcttttaaagattcaagtgtaagattttgttaatcttacacttctaaaagaaatgcttttgtaattcctgcaggtttgggtacaatcttctcaaagttcaaatatcaattactcaacataagagccctcataaaaatgccaacataaatgagaatggaaggagaaacagatccaggtaataagatttacttcactgaaaacatcatgttgtattaacatatgtgcttgtttttatgttgccatttaaactctaaacaaagtaagattatgaaacctgaattaatacaaggaaatgacatttatgggtatgacaatagtaacacagcaggaagtttactccctactccctattcctagtcttcctcaatctaggaaacaagactttctggggagtatacatttcaaacacaatatttattgagtatcttctaaaaatacagtaataatacaatcttaatatttaggcttctagaccttcactttacaacaatacaggcatacctctgagatattacgcacttggttccagaccactgcaataacggtaatattgcaataaagtgagtcacacaaattctggggtttctcagagcatacaaaatttatgtttacacgattctgtagcctattaagtgtgcaacagcattatgtctaaaaaacaatgtacacaccttaataaacacctcattcctaaaaaaaaaaaaaaaaaaaagctaatgattcttctgagccttcaatgaattgtaattattttgctggtggagggtcttgccttgatactgatggctactgactgatcagggtggtgactcctggatgttggggtggctatgacaatttcttaaaataagacaaaaatgaagtttgctgcatccattgactctttcatgaaaatattcttttgattttgtaaaaatatttttaaaattctttattatttaaataaagatgaggtccactatattgcctaggctggtcttgaacttctggcttcaatgactgtcctgactcagtctcccaaagtgctgggattacaagcgtaagccactgtgcccagcccatgaaaatatttatctgcagcatgtgatgctgttgcattttacccacagtagaacttctttcaaaactggagtcagtcatctcaaaccctgctgttgctttatcgactaagtttacaaaatattctaaatcccttatcatttcaacaatgttcaaaacagcttcaccttcgtagactccacctcaagaaaccactttatttgctcctccataagaagcaattcctcatccattcaagtttatcatgagattgtagcaattcagtcatatcttcaggctccccttgccattctacttctcttgctatttctaccacatctacactgacttcctccactgaaatcttgaagaatggagtcaacttcttccaaactcctgttaatgttgacattaacattaacatgacattaactccatgaatcaaaaaagttctgaatggcatctagaatgatgaatgatgaatactttttagaaggctttcaatttactttgcccagatccattagaggaaccattatctatggctacagccttaaaaaaatgtatttcttaaataagaagacctgaaagtcaaaatgacttcttgatacattggctgcagaatggatgtcgtgttagcaggcatgaaaacaacatgaatctctttgtataatacatctccatcagagctcttgggtaactaggtgccttgtcaatgagtagtaatatttggaaataattttttttttctaaccagtaggtctcaacagtgggcttaaaatatttacagcaaaccgtgctgttaacagatgtgcagtcatccaggctttattgttccatttatagaacacaaatagaatagatttagcataattcttaagggtcctaggagtttcagaatggcaaatgagcactggcttcaacttaaagtcaccagctgcattagctcccaacaagagagtcagccagtcttttgaagctttgaagccagctattgacttctctttagctttgaagccaggtattgacttctctttagttatgagagtcctagatggcatcttcttccaatagaaggctgttttatctacactgaaaatctgttgtttagtattaccacctttatcaatgatcttagctatatctcctggataatgtactgcagtttctccatcagcacttactgctttaccttgcactttcatgttatggaggtggcttctttccttaaaccttatgaaccaatctctgctagccaacaatttttcttctgtagcttccttatctctcctagtcttcacggaattgaggagagttagggccttgctctggattaggctttggccaaagagaatgttgcggctggtttgatcttctatctagaccactaaagctttctccatatcagcaagaaggctgttttgctttctttctttcttttttttctaagagatggggtcttgctctgtcacccaggctggagtgcagatccaggcacaataatagctcactgcaaccttgaaatcctaggctcaaatgatcattctgccttagcttctcaatgtggttgggactataggtgtgtgccaccacatccagctaatttttctttctttctttctttctttttttttttttagagacaggttctcactatgtcatccatgctagtctcaaacttctggcctcaagcaattctcgtgcctcagtctcccgagttgctgagactacaggcacctggctgtttcgctttcttatcatgtgtgttcactggagtagaactttttttttttctgagatggagtcttgtactgtcgcccaggctggagtgcaatggggtgcaatggctcagtgaaacctccgcctccctcctggatttacatgattctcctgcctcagcctcctgagtagctgggattacaggcacacaccaccacgctcagctaattttttgtatttttagtagagatggggttcactatgttagccaggctggtctcaaactcctgatctcatgatccacctgcctcggcctcccaacatgctgggattacaggcgtgagccactgcacctggtctggggtagcacttttaatttccttcaggaacttttcctttgcattcacaacttggataactggcgcaagaggcttaattctgtgcctatctcagctttcaatatgccttcatcaccaagcttaatcttgatttcaggtgacagacatgcaactcttttacttgaatacttaagaggccactgtaagtcattaagtggcctaatttcaatattattttgtcttagggaataagatctgaggagtgagacaggggaactaccagtcagtggagcaattagaacacacacattcatcaattaaatttcccatcttatatgggtgaagtctgtggtgcctcagaacaattacaacagtaatatcaaagatataatgacaataatgaaaaagtttgaaatatggcaagaattacaaaaatgtgacacaaagacacaaaatgagcaaaagctgttgggaaaatgacactgatagacttgcttgatgcagggttgccacaaaccttcaatttgtaaaaaatgcagtatttatgaagcacaataaaacaaagtatgcctgtatttattttgttcaaaaaaggatggaaacattgctttagtcccatagttcagtattattgaaaaagtatactgatatttaagatgttactacaaataggccgggcgcagtggctcacacctgtaatcccagcactttgggaggccaaggcgggtggatcacaaggtcatgagtttgagaccagtctggccatcatggtgaaaccctctctctactaaaaatacaaaaaattggccgggcatggtggtgtacacctgtagtcccaagtactcgggaggctgaggcaggagaatcacttgaacccgtgaggcagaggttgcagtgagccgagactgtgccactgcactccagcctgggcgacagagtgagactctgtctcaaaaaaaaaaaaaaaaaaagttactacaaataacttttaaaaatatctagagctcacctaacagtattatcaccttgaaagattatatctaaatattttgaaactttgtttgttttaattactatagtatataaattcaaataaggtttcatacactgagagaataaaaacaagctccaaagttgttctgaatagtagcagtatttttagaacaaatatgttatttctctagatgattacttaaaagaaatatactttgaatgaacacattctgctatttttatttaaatcagtaatcacttctctaccacatactaggattacagttatgtgccaccatgcccagcacatttttgtatttttagtagaaatgggatttcacatgttggccaggctggtctcgaactcctgaccccgtgatctgcctgccttggcctcccagagtgctgggattacaggcgtgagccaccgcgtttggcctgctatttcgatacatcaatctgacacgatttctgtgagaagacaaatccacaatatttgacaaaaattatcaataaattaaaatacatattaatacctattaaggccaagcacagttctagataatgatatccaaaatgaattagacacaatattttctctgaggggactgtaaattagaaaagaaaaaagaacacataaatcaatcagtatgttacagagaaaaaaataaagagataagtactaaacgatctggggaagaatgaaacaaaaaatatagaaagaactaactctgtaaagccaagaggggcaccagtgagaacagccttcgcagagcagccaatggtcagccattcattgttcgggaaggccataaaacacagataaagtaggacagttgtacattcaaatcccaaaacactcaccagtcctgtgatttttcattgtttttatcctctctgaacctcacagtttttctctaaaatagaaatgctgtactctttgcctctctgctatagggattgcatgagataatttacgtaaagtacacatctgtgtacctaataaatagtagcaattgttatttatttggtttccattaaataaggttatttggcttaaacactacaagtctggttttagttcctgatgaaatgtattaagtttcagaatgcaagtttctcatctttagaatgcagactaaaaacaaaaacctcctatcttaaccatgatcagaaattaaaatttgagcattgtgagagacaaatttattggcacttttataataatgatcttcagcagccttcagtaaatgcttatgttctataatcaaatgcatactgatctctcctctgagtcaactaaaccaaacagattagaagaacctaaacagacaaattcagacatggaatctaaataaatgaacaaagacagattactaactcttacaataacttaagaagacaactaagttactgaaaatttatgggtggttcaggatgactactgaaatgtggcaacatcattataagctaatgtcatacacttaagtaacttattagtacagttgaattgggccttctgtataaatatcatggtgtattatttataatcagaaccttaaagcttttcaatattaactacatcttgagataaaagatgataatgtacttctaattattgaaagataaaccattacactaagccttttatacggaaagttgagcaaatatgacatatcacaaaaattaactaagccaggaaaacaatataaagtttcatataagagaaaaatataaaaatttggaacaaagaatgacccaattttattatacaattgatcacccagctaaatctataatatatatttcattctaaacatactttttcactgggtgcaatggctcacacctataatcccagcactcaggaggctgaggcaggaggagcacttgagcccaggagtttgagacccagttaattttcttttttcttgtagaaatggagtctcaccagaccagtgagactccatttgtacaacaaataagaacattagcttatgtatggtgacgtgtgctaagggtcccagctatagacaggctgaggcaggaggatcccttgagcccagcaggtcgaaattgcagagagccatgttcacaccacggcactccagcctgagtgacagagcaagaccctgtttcaaaacaaaacaaaacaaacaaagcacagtctttcaaagtttaaccacagttttaaatataaaaatgtgcaaaaaaaaagataaaacattgacctgaaagtttcataattcagttttaaaagaaatgctttagaagctttttttttcttagccatttttctcacaaggttcataaatttaaggcttttcaacattgcttttattgtcacaaaaggttttcaattatcgctgtaaaactgtttctacttcacgtgtcaattttgccatgtgctgaaaaattaagcagcagtgccaccaaatgacgaaactcaaaatttcaccaaatagtgaggcgaggcttacaaacacatgaaaccaccagtctgcctactcttgatgtctgcctactcttgatcaataacaaacatattttcatctttatgctgacttattagtaaggatttaatgtatgctaggaaagtattaaatgacttagtttcatattttgaatagagtaatttcacacagttttatacagcctaaagatatatcatggccaaatcttatcaaattcatatttaatgtctcaaaaccttatctttgaagaaccaatagtataaaagtatttgtatttgaataaattttcttaactagtattgccataatgcttttataagaatatctaagaataagaacaaggtagccagaagcaatgagtgtgtacaccctgtggggagccttacaggcgtgcatggaaagtctaaaaataagacaaagatggaaacagaaatacacaagaatttacattcaaaatattttatccaacctaaccaagacagaatctccctaattctatttttcactgaattttaattcttaaaacattgctacccttttaaaaaactgaatcgatcttccttacatacttcattcacaatatagcatacgtgatggctgaaaacctaacactatattacttggccctcccaaaaaaaggacccatcatcacatattgttctccatatctaaatcccaattggtactacaatttttatcattaaatatgtcaaagagaaaattttataaaattaggtatatactgccaaagaatcacaatagttaaggcagtgatttttttttccttcacttttaagttccagggtacatgtgcagaatgtgcaggcttgttatataggtaaatgtgtgccatggtggtttgctgcacagatcaactcatcacccaggtattaaggccagcatccgttagctattcttcctgatgctctcccttcctccacatccctcaaaagccccaatgtgtgttgttcccaccaatgtgttcatgtattctcatcgttcagctcccacttataagtgataccatgaggtgtttggttttctgttcctgtgttagtctgttgagaataacagcttccagctccatcaatgtccctgcaaaggacatgttcttgttcctttctgtggctgcatagtattccatggtgtatatgtaccgtgttttctttatccagtctatcactgatggaaatctgggttgattctatgtctttgctatcgtgaatagtgctgcaatgaacatacgcatgcatgtatctttataacagaatgatttatatattttggggtatatacccagtaatgggattgctgggtcaaatggtgtacctgcttctagatctttgaggaatccccacactgtcttccaaaatggctaaactaatttacactcccaccaacagtgtaaatgcattcctttttctctgtaactttgccagcatctgttgtttcttgattttttaataattgccattctgactgatgtgatatggtatttctctgtggttctgatttgcatttctctaatgatcagagatgttgagctttttttcatgtttgttggctgcatgcatgtcttctttttaagaagtgtctgtttatgtcctttgcccattttttaatgcgtaaaaatggacatttttgtttttttcttgtaaatttgtttaagttccttgtagactctggatattagctctttgtcagatggatagattgcaaaaattttctcccattctgtaggttgtctgttcactctgatgacagtttcttttgctgtgcaaaagctctttagttaattagatcccatttgccaatttttgcttttgtcgctattgcttttggcatttcatcatgaaatctttatttgtgcctgtgtcctgaacgatactgcctagattttcttctaggatttctatagttttgggttttacatttacatctttaatccatcttgcgttaacttttgtataaagtttaaggaagggggatccagtttcaattttctgcatatgactagccagttctcccagcaccatttattaaataggaaatcctttccctattgcttgtttttgtcaggtttttcaaagatcagttccgtgtaggtatgtggtttatttctgagttctctattctcttccattgttctatgtgtctatttttgtaccagtaccatgctggtttggttacagggcagtgatttttatcctttgttagattgaaaatattatacttttgagaatccaaggaaatatacgtggttttactgaagaaaatgcaccaacatacatactgccaaactttacattaatattttagggggcttaataatgctagcttcaattctgaattccatgttaaccactcctgagtaacggtcaatgagtaaagatagatatatgaacactaccccccaatataacatctagattatgctatattagactttctattgaaataatagttaaataactttaatcaatttttttttgtatattaagctggatctaaatacttacattatggatactatttttctatacaatttagatagagcaacattagagaatatgcccttcatctagacgaggaaataaaggccacaaacattaagtcaatcttcaaacaagctaattaattggcaaggctgagaccaaaatcaggtattctgattcccagtctcatttttttcccactataccagtgtgcattaaataaacagatgtttcctgaacatttccttatgcacagctctggaatatcatgagacacagaattcccaatgaatttatttgtgttactattcaccaggtaccatgctgagcattttacgtggtaaatcagttaagattctttggttgaaggcaatagaaactaactatagaggggcggagggagggagggaaggaggcagctaggtagccaggcagccaggcaaggagggtggtgacatcagcaggatggcaaattacaaatgcctaatgctctaccctctgccccacaaaaaaggacaaaaacaatgaattgataactgcattttgaccagagtgacttaagaatgtcagagaatagcaagggagtggcagaaaccctgtgaagcacaggctaagtatggccatatacagaagggtggagtcattgttgtgctattcccttccccaatgcctaagtcacagctgtgccccaccattcatgggcccttgttgctgctgtacccagcctcacaaagtctggtccattgctatgtcctgccatgccagagtcaccactacaaggaacctcctctcctggtgtccaagttgccactatgccctactggctccagaaactgaagtgcagttatgccctgctccctagggtccaagcctctagaacatctcttcttctccagacccatgccagtgctgtgccctgactctcaggatcagagtcacagctatatccctgctacctgggcccaagctactggggaatgccttagagtcagtccccacctttgtagaacagcttcatctacccatacctcagagagtgaacttgtactcaagtcacaagtatcatagtaattcaggaagacagtgggcccaggaccctagcaccactgtaggctgcttgtgagctctgccaaatctgacaacaagaaggatttccccaacaaagtctccccacggtacgataaacaagagcaggaggacccccactaaagcccttgtcactgagaatcctaataacctatgctgctaccactgctgtcacacactcctacagtcatggctaaagtacctgcagccattactcaaattgattacaactgaaggagctgcatggacactacactaccgtgcctacctggaaccagaggcagaacctctgcccttgagccactgcaccaccacccacagagccaatgcaccctgctcaactgaccccctagcaatcatctataggtaaaatcatcccctacaaaagcaactctatagatttggaagaggtcactgatccactagatgtgcagttatcaatgcaaggacacaagaaacatgaaaaagcaggaaaacatgacaccatcaaaggaataattctccagataatgaccccaaagaaatggaaatttacaaattacctgatagagaaatcaaagtaatgatcttacggaaactcagggatatacaagaggatagacaattcaatgaaatcagcaaaataatccatgatatgaatcacaagctcaataaagatatacataacacaaaaagaaccaaacagaaatcttggggctgaagaattcaatgaatgaaattgttaaaaactgagagcttcaacagcagactagatcaagcagaggaaacaatctgtgaatttgaagataggtcttttgaagttgcccagatagagaaaaagtgaagaaagcctataggaattatggaacaccatgaaaggaacaaatgtcacagtatgagctctagaaagagaagagatgaggccgggcatggtggctcacgcctgtaatcccagcactttgggaggccaaggcgggaggatcacgaggtcaggagatcaagaccatcctggctaacatggtgaagccctgtctctactaaaaatacaaaaaattagccaggtgtggtggcatgcgcctgtagtcccagctacttgggaggctgaggcaggagaatcgcttgaacccaggaggtggaggctgcagtgagccaagattacgtcactgcactccagcaacagaggaagactccatctcaaaaaaaaaaaaaaaaaaaaaaaaaaagagagatggagaaaggcacagaaggctttttaagtgaagtacttgctgaacacttcccaagtcttgggagtgatatggtcatccatatctacagaagttgaaaactaacaaacaggttcaatgcaaagaggtcctcaccaaggcactttataatttaaaacattaaaagtaaaagacaaagaattttaaaagcagagggagaagagcatcaagcaacatacaaggggctcgccattagactatcagcagatttctcagcagaaatcttgcaggtcaggagagaatgggataatatactcaaggtgctaattaaaaaaaccctgccagccaacaatactatacttagaaaagctgtttttcagaaataaaatagaagtaaagtctttcccagatagacagaagctaagggaattcatcacctctagaactgatttacaagaaatgcttaagagttcttcaaccagaaacaaaagaacaataactactaccacaagaacatatcaaagtataaaactcactggtagagaggtatttatatatattcaaattcagaatattccattactgcaacaatggtgtgtaaatctctcaaattgctattataaaggttaaatgttgaaacagtaaaaaacaactgtaattgcattaagttgttatgaagtccaaaatgtaaaaaggtataaactgtgacagccaaaataattgtgaggagggtaaaagtctagaatatcttcatgtgacaaagttaaattgttatcagcttaaaatagtctattattactataagatgctttgtgtaagcctcatgattaactacaaagcaaaaaactacagtagatacacaaatgagaacgagaaaggaatcaaaacttagcacatagcacaaaatcacaagagtagacaataagagaagaagaaaggaacaaaggaccaaaaaacaaccagaaaacaataacaaatgcagtagtacgtgcttacctatcaataacaatcttcaatgtaattaagctctccaatcaaaagatttagaatggatggaaaaataagattcagacgctgcttcaagattgtgactacggacatctcatgcccgttctcctcagaaggaagatcaaaattactggtaaatcatcaagttttgacaaggaaacagagggaacagagccaggacctgttggagtacccacgtgaagaagattgggtggagagaaagaaagcagcaaaagtctggttgatagcgaccgctgaggaactcagagtccagcagaaactgtaggtgggagtgtgtctctgctcccctcacccctctgacaacacactggctgctaaacagctggggagcccctcagcccttgcaagccagggcaacactatcggtggcgattagaggacttcctgaaaacagagaactgggtgagcagctgacttagccatgctgcacccacctctgatccaaactgagatggcagttgtcataccagttgtgtacctgtggtgccactccccttgcttgtagatcctctgcccttgagccactgcaccaccacccgcagacatactacacaacctactctgactttggcaagtacatgacaccagcagattctcagggagtttggggtctcccacagattgaacacttggcacaaactgcccctcaaggaggagacagagcagcctgtcaaagccaccaatgggaaacaggaaatgtgggtgcagcactaaccactgaagggggcagcgccaatgcctcggaacaaacgtggagaagggggtcatctctcaccttctcatctcgccaaagtgcatgattgtggacatggcagcagttctttctgttggggcccaatggccctttctgggcttctctggtggctcgatgaaagtgaacagagcctaaataaatctgctgtatcttactcttcggcaccatctactggactgcagcctgaattacaccgccaagcaaaaactacaaaaaacagcatctgagaaagccaccacacaaacctacctgcaaccaaaaaacccatatggagctttggccccctaaaagcacccagaaaagaagccaatcgagcatacacaacatacatcacagttacaccttcaaggggaaaaaaaataagtcccatccaaataaacacaaatccaaaaaaagaattgtcagctcactcagatgagaaggaatcagtgaaagaactctggaagtacaaaaagccaaggtgctttgtcatctccaaaggatcgttctagctccctagccatggatcctaagcagactgaaatatctaaaatgatacataaagaacttggaatattgatggcaaggaaactccacaagatctgagaggaagttgaaatccaatacaaagaagccagaaaaatgatccaggacatgaaagatgacataatgatattaacaaagaaccaaacagaacttttggaattaaaaaactcactatgggaatttcaaaatacagttggaagccttaacaacaaactagacaaagcagaagaagaatttcagagctcaaagactggtcttttgaattaacccagtcagacaaaaataaagagaaagaatttaaaaaagcaaacaaggccttcaagaaatataagattatgtaaagcaaccaaaccaatgaattactggcattcctgagagagaaaaacagaaagtaaggaaactggaaaacatatttcagggtatgattctgaaaaatttccccaatcttccaagagaggttgatatgcagacacaagaaattcagagaacaccagtgagatactatataagatgaccatcaccaaggcacacagtcatcagacaatccagggtcaatgtgaaagaaacaatcttaaaggcagctagagaaaagaaccaaattgcctcttttaaagggaatcccatcagactcacaacggatttctttcttttttttttttttatactttaagttttagggaacatgtgcacaacgtgcaggtttgttacatatgtatacatgtaacatgtttgtgtgctgcacccattaactcgtcatttaccttaggtatatctcctaatgctatccctccccactacccccaccccacaacaggccctggtgtgtgatgttccccttcctgtgtccatgtgttctcattgttcaattcccacctatgagtgagaacatgcagtgtttggtttttgtccttgtgatagtttgctgagaatgatggtttccagcttcatccatgcccctacaaaggacatgaactcgtcatttttgatggctgcatagtattccatggtgtatatgtgccacatattcttaattcagtctatcattgttggacatctgggttggttccaagtctttgctattgtgaatagtgccgcaataaacatacgtgtgcttgtgtctttatagcagcatgttatataatcctctgggtacatacccagtaatgggatggctgggtcaaatggtatttctagttctagatccctgaggaatcgccacactgacttccacaatggttgaactactttacagtcccaccaacactgtaaaagtgttcctatttctccacatcctctccagcacctgttgtttcctcactttttagtgattgccattctaactggtgtgagatggtatctcattgtggttttgatttgcatttctctgatggccagtgatgatgagcattttttcatgtgtcttttggctgcagaaatgtcttcttttgagaagcgtctgttcatatccttcgcccactttgtgatggcgttgttcttttcttgtaaatttgagttcattgtagattctggatattaggcctttgtcagatgagtaggttgcaaaaattttctcccattctgtaggttgcctgttcactctgatggtagtttcttttgctgtgcagaagctctttattttaattagatcccatttgtcaattttggcttttgttgccattgcttttggtgttttagacatgaagtccttgcccatgtctatgtactgaatggtactgcctaggttttcttctagggtttttatggttttaggtctaacatttaagtcttttttttttttttttttttttgagacggagtttcgctctgtcgcccaggctggagtgcagtggcgcgatctcgactcactgcaagctccacctcccgggttcacgccattctcctgcctcagcctcccgtgtagctgggactacaggcgcgcgccaccatgaccagctaatttttgtatttttagtagagacggggtttcaccgtgttagccaggatggtctcgatctcctgacctcgtgatccgcccgtctcggcctcccaaagtgctgggattacaggcgtgagccaccgtgcccggcccatttaagtctttaatccatcttgaattaatttttgtataaagtgtaaagaagggatccagtttcagctttctacatatggctagccagttttcccagcaccatttattaaatagggaatcctttcctcatttttcgtttttgtcaggtttgtcaaagatcagatagttgtagatatgcagcattatttctgagggctctgttctgttccattggtctatacctctgctttggtaccagtaccatgctgttttggttactgtagccttgtagtatagtttgaagtcaggtagtgtgatgcctccagctttgttcttttggcttaggattgacttggcaatgcgggctcttttttggttccatgtgaactttaaagtagttttttccaattctgtgaagaaagtcattggtagcttgatggggatggcattgaatctataaattaccttgggaagtagggccattttcacgatactgattcttcccacccatgagcatggaatattcttccatttgtttgtatccccttttatttcattgagcagtggtttgtagttctccttgaagaggtccttcacgtcccttgtaagttggattgctaggtattttatactctttgaagcaattgtgaatgggagttcactcatgatttggctctctgtttgtctgttattggtgtataagactgcttgtgatttttgcacattgattttgtatcctgagactttgctgaagttgcctatcagcttaaggagattttgggctgagacgatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtgtgatattggctgtgggtttgtcatagatagctcttattattttgagatacgtcccatcaatacataatttattgagagtttttagcatgaagggctgttgaattttgtcaaaggccttttctgcatctattgagataatcatgtggtttttgcctttggttctgtttatatgctggattacgtttattgatttgcgtatgttgaaccagccttgcatcccagggatgaagcccacttgatcatggtggataagctttttgatgtgctgctggattcggtttgccagtattttattgaggatttttacatcgatgttcatcagggatattggtctaaaattctctttttttgttgtgtctctgccaggctttggtatcaggatgatgttggcctcataaaatgcgttagggaggattccctctttttctattgattggaatagtttcagaaggaatggtaacagctcctccttgtacctctggtagaattcggctgtgaatccatctggtcctggatttcttttggtgggtaagctattaattattgcctcaatttcagagcctgttattggtctattcagggattcaacttcttcctggtttagtcttgggagggtgtatgtgtcgaggaatttatccatttcttctagattttctagtttatttgcgtagaggtgtttatagtattctctgatggtagtttgtatttctgtgggattggtggtgatatcccctttatcattttttattgcatctatttgattcttctctcttttcttctttattagtcttgctagcggtctatcaattttgttgatcttttcaaaaaaccagctcctagattcactgattttttggagggttttttgtgtctctatttccttcagttctgctctgatcttagttatttcttgccttctgctagcttttgaatgtgtttgctcttgctcctctagttcttttaattgtgatgttagggtgtcaattttagatctttcctgctttctcttgtgggcacttagtgctataaatttccttctacgcactgctttgagtgtgtcccagagattctggtatgttgtgtctttgttctcattggtttcaaagaatatctttatttctgccttcatttcattatgtacccagtagtcattcaggaacaggttgttcagtttccacgtagttgagcggttttgagtgagtgtcttaatcctgagttctagtctgattgcactgtggtctgagagatagtttgttataatttctgttcttttacatttgctgaggagtgctttacttccaactatgtggtcaattttgaaataggtgtggtgtggtgctgaaaagaatgtatattctgttgatttggggtggagagttctgtagatgtctatcaggtccccttggtgcagagctgagttcaattcctggatatccttgttaactttctgtcttgttgatctgtctaacgttgacaatggggtgttaaagtcttcccattattattgtgtgggagtctaagtctctttgtaggtctctaaggacttgctttatgaatctgggtgctcctgtattggatgcatatatatttaggatagttagctcttcttgttgaattgatccctttacaattatgtaatggccttctttgtctcttttgatctttgctggtttaaagtcttttatcagagactaggattgcaacccctgcctttttttgttttccatttgcttggtagctcttcctccatccctttattttgagcctatgtgtgtctctgcacatgagatgggtttcctgaatacagcacactgacggatcttgactctttatccaatttgccagtctgtgtcttttaattggagcatttagcccatttacatttaaggttaatattgttatgtgtgaatttgatcccttcattatgatgttagctggttattttgctcattagttgatgcagtttcttactagcctcgatggtctttacaatttggcatgttttttcagtggctggtactggttgttcctttccatgtttagtgcttccttctggagctcttttagggcaggcctggtggtgacaaaatctctcagcatttgcttgtctgtaaagtattttatttctccttcacttatgaagcttagtttggctggatatgaaattctgagttgaaaattcgtttctttaagaatgttgaataatggcccccactctcttctggcttgtagagtttctgcctagagatcagctgttagtctgatgggcttccgtttgtaggtaacccaacctttctctctggctgcccttaacattttttccttcatttcaactttggtgaatctgacaattatgtgtcttggagttgctcttctcgaggagtatctttgtggcattctctgtatttcctgaatatgaatgttggcatgtcttgctagattggggaagttctcctggataatatactgcagagtgttttccaacttggttccattctccccatcactttcaggtacaccaatcagacgtagatttggtcttttcacatagtcccataattcttggaggctttgtttgtttctttttattcttttttctctaaactcttctcgcttcatttcattcatttgatcttccatcactgataccccttcttccagttgacaaattggctactgaggcttgtgcattcgtcacgtagttcttgtgccatgattttcagctccatcaggttctttaaggacttctctacactggttattctagttagccattcatctaatttttttttcaaggtttttaacttctttgccatgggttcgaacttcctcctttagcaaggtgtagtttgatcatctgaagccttcttctctcaactcgtcaaagtcattctctgtccagctttgttctgttgctggtgaggagctgcattcctttggaggaggagaggcactctgatttttagagtttccagtttttctgctctgttttttccctatctttgtggttttatctacctttggtctttgatgatggtgacatacagatggggttttggtgtgggtgttctttctgtttgttagttttccccccaacagtcaggaccctcagctgcaggtctgttggagtttgctggagatccactccagaccgtttgcctgggtatcagcagcggaggctgcagaacagtggatattggtgaacagcaaatgttgctgcctgatcattcctctggaagttttgtctcagaggagtaccaggctgtgtgaggtgtcagtctgcccctactggggggtgcctcccagttaggctactcgggggtcagggacccacttgaggaggcagtctgtccgttctcagatctgcagctgcgtgctgggacaaccactactctcttcaaagctgtcagacagggacatttaagtctgcagaggattctgctgccttttgtttggctatgccctgcccccagaggtggagtctacagaggcaggcaggcctccatgagctgcggtgggctccacccagtttgagcttcccggccactttgtttacctactcaagccttggcaatggtgggcacccctcccccagcctcgctgccgccttgcagtttgatctcagactgctgtgctagcaatgagcgaggctccgtgggcataggaccctctgagccaggcgccagatataatctcctggtgtgccatttgctaagaccgttggaaaatcgcagtattagggtgggagtgacccgattttccaggtgccgtctgtcacccctttctttgactaggaaagggaattccctgacctcttgcacttctcgggtaaggtgatgcctcgccctgcttcggttcatgctcggtgcgctgcacccactgtcctgcacccactgtctgacactccccagtgagacgaacccagtacctcagttggaaatgcagaaatcacctgtcttctgtgttgctcaagctgggagctgtacactggagctgttcctattcggccatcttggctcctcctccaacaatggatttcttagcagaaatcttacaaaccagaagacattggtggcctatttttagccttcttaaagaaaagaaatgccagccaagaatttcacagcctgccaagctaagtaagcttcataaacaaaggagaaataaagtttttcccagacaagcaattgctaagagaatttgtcaccagcagataggccccacaaaaatgcttaaaggagttctaaacatgaaaataaaagaatgatacttgctgccacaaaagtacatgtaagttcaaagcaactgccactataaagcaactatacaattgagactacaaagcaatagttaacactaagagaggaagaaaacctcacgtatcagtattaacgctgaacataaatggcctaaatgcttcactacaaacacagaatggcaaattggatgaaaaaacaagacccaaccatctgctatcttcaagagacccatctcacatgtaatgacacccaaaggacttgatgtaaagggatggagaaagatcacacaaatttaaaacaaaaaagatcagggcttgctactcttgtatcagataaaacagactttaaatcaacaacagtacaaaaggagaaagaaaagtactacataatgataaaaggttcaattaaacaagaggatttaactatcctaaatatgtacatgcccaacacttgaggaccctgatttataaacaattactactagatctaagaaaagggacagacaataatatcatacaataatagtggacactttaacaccccactgatagcattaaactgatcaaggcccaaaactaataaattctagacttaaattggacacttgaccagttggtcctaattagcatctacagaacactccaccaaacaaccacagaatatacattctttttatctgcacacagaacatagtctaagactgaccacatactcagtcataaagcaagtctcaataaattttttaaaaaactgaaatcatactaagcatcttcttggaccatagtagaataaaaatagaaatcaataccaagaggaactctcaaagccacacaaatacatggaaagtaaacaacctgcttctgaatgacttttggaaaacaataaaattaaggcagatatttaaaaaaatttttgaaacaaatgaaagtagaaacactacataccaaaacctctgagatatggtaaaagcagttaaaaggaaagtttacagcattaaatgcttatacaaaaataatagaaagatctcaaattaacaacctaatgctgcacctacaggaactagaagaacaaaaagaaactaaatcaaaagctagccgacgaaaagaaataactaaaatcagagcggaattaaattaaattgagaccaaacagccatagaaaagatcaaagaaaagttggttcttcaaaaagataaacaagattaataaacttctggaaagattaacacatgaaaaaaagagaagattcataaacacagtcagaaataacaaaggtgacattacaacggatcccacagaaatacaaaagatcctcagagactactataaacatccccatgtgcacatactataaaattaggaaatgaacaaattcttggaaacacacaatctcccaagattgaactaggaagaaactgaaaccttgaacagaccaataatgagtacaaaattgaaacagtaataaaaaaaaaaaactaccaatcaaaaaaaaaagtcctggaccagatagattcacaagatatacaaagaaggctgatgccaatcctactgaaattattgaaaataaattaagatggagagattcctccctaactcattctacaagaccagtttcatcatgatatcaaaatatggcaagggcacaacaaaaaaagaaaactacaggccaatgttgctgatgaaaatagacacaaaaatcctctataaaatattagcaaactaaatccagtagcacattaaaatgaaaatttgtatgatcaagtgagccttattcctgggatgcaaggatggttcaacacacacaaaccaataaatgtgattccccacataaacagaattttaaaaaagaatatgatcacctcaatatacacataaaaagcatctgataaaatccaacattgctttatgataaaaaacacttaacaaattaggcatcaaaggaagatatctcaaaatattaagaaccacctatgacaaacccacagccaacatcatgctgaatgagcaaaaagttagaaggattcctcctaagaactagaacaagacaaggattccattcttagcaatcctattcaacatagtactggcagtcccagccagagcaatcaggctagagaaaaaaataaaagacatccaaataggaaaagagaaagtcaaattatctctttgtggacaatttaattctgtacctggaaaattctaacaattccaccatgactcctagacttgatgagtgacttcagtaaagtttcaggacataaaatcattttacaaaaatcagtagtatttctatactccaataccattcaagctgagaatgaaatcagtaatgcaatctcatttacagtagccactcacacacaaaaatactgaggaatacatttacccaaggaggtgaaagatctctacaaggagaactacaaaacactgatgaagaaaatcatagatgacataaacaaatggaagtgcatttaatgcccatggaaggagacttggtatcattaaaatgtccatactgcctgaagtaatctacagaatcaattcaatttctatcaaattaccaatgttatttttttgtaaaaaataaaaaaacctaaaattcatatagaaccacaaaagacccagaatagccaaagttatcctgagcaaaaagaacaaaactggaggaatcacattacctgacctcgaattatactacagagctgtaaccaaaacagcatggtgctggcataaaaacaggcacatagaacagtggaacagaatagagaacccagaaataaatccatacatctatagtgaattcatctttgacaaatgttccaggaatctacgtttgagaaaagacaatctcttcaataaatggtgctgggaaaactggatatccatatgcagaagaatgaaactagactcctatcttttgccatatacaaaaatcaaatcaaaatgtattaaagacttaaatctgaggcctcaaactatgaaactactaaaagaaaacactggggaaactctctaggacactggcctaggcaaagatttcttcagtaatatcccataaccacaggcaacctaagtaaaaatggacaaatggacttgattgcacatcaagttaagaagcttctgcacagcaaaggaaactatcaacacagtgaagagacaacccacagaatgggagaaaatatccgcaaactacccatctgacaagggattaataaccagaatatataaggacctcaaaccactcaacaggaaaaatctgataatccaatttaaaatgggcaaaagatctaaatagacatttctaaaaagatgacatacaaatggcaaacaggtacatgaaaaagtgctcaacatcactgatcatcagagaaatacaaatcaaaatgacaatgagttatctcaccccagtcaaaacagctttcatcaaaaggactagcaataacaaatgctggcgaggatgtggagaaaagggaaccctcttacactcgtacactgttggtaggaatgtaaactagtacagccacttatggagaacagtttggaggttcctcaaaaaactaaaaatagaactaccatacaatctagcaatcccactgctaggtatatacccaaaagaaaggaaatcagtatatcagagatatccgcactcccatgtttattgcaggactagtcacaatagccaaaatctggaagcaacctaattgtccatcaacagatgagtggataaagaaaactgtgggacataaacacaatggagtactattcagccataaaatagaatgagatcctgtcatttgcaacaatatgaaaggaactggagttctattacgttaggtgaaataagcccggcacagaaagacaagttttgcacgttttcacttatttgtggaaactaaaagaattaaaacaattgaattcatggaaacggaacatgattgttatcaaaagctggaaagggtagtgcatgaaagtgggaatggttaatgggtacaaaaattagataaaatgaataagattcagtatttgatagcacaacagggtgaatatagtcaacaataatttattgtacctttaaaaataactaaaagagtgtaactcgattgtttgaaatgcaaagaaaggataaatgcatgaggtgatagatacccatttaccctaacgtgattagtttgcatttatgcctgtattaaaatatctcatgtatcccataaatatatacatctaccatgtacctacaaaaattaaaagtaaaaaaaaaattttttttaaggcacaacttacagaaaacaggggaaacagcgtaagaaaaagacttcaacattgggcagatccaggttcaaatctttgttctgcccttagttggaaatattttatataattattttatcctttctatatatgctttgtaaagttgtaaggattaaaaaaaacaataaatatacagttaatccttgaacaacacaggtttgaccagcacaaatccacttacacacaatttttttttctgcctctgccacccgagacagcaagaccaaccctcttactcctccttcctcagcctactccacctgaagatgagcatgaagacctttatgatgatccacttccatttaaaaatagtaaatatattttctcttccttatgattttcttaataacatttttcctttagctttgttgtaagaatacagcatataatacacataacataaaatatatgttactctatgttactggcaaggcttccagtcaacagtaggatatcagtagtaaagactacggggagtcaaaagtcgtatgtgaatttttgactgtgcaaggggccaatgccccaacccccatgttgttcatgggtcaatagtagagtggttataatatgcctggcataaaacaagcaataaactataggaactgttgttactatgatgtatatcacgactatttgccaatgatctagttgtaggctaaaacccagaaaattaacttaaaattggcagaacaggaaaactcactggataagaggataagcaaaaactcaaaatgtctgcaaatattagcaatattctgttaggaaaaaaaacctttaaagattgaaatggaattataaactatctagaaataacctttataagaaatacaacagataagtgtgaaaatgatcaaaatttgtgtaagagatataaaagaaactatgagtaaatgtagaaatttaacttgtttctgtataaaaactattataactatgtcaattcttcttaacttgtaggtttaatataatactaatcaaaattacaatatgattgaaaaaaaaaaagaaacaagaattaccctaaaaatgtatctggtaaagaaaaagagagcaaataactaagaacaataagtgtaaaaaggagagtaaaggggaaatgcggaaagaattctattagaaattaaagcatattgtaaataattactaatacaacgaggtactggcagaaaagacagagtaacagagcaaaggagaaagcccaaaggaagatatagcttgatacatacttgctatagattcattcactgttttatataagaatttaataaatcttacaagtagcattataaatcagtgacagaaggatgatgtagtcattaaattatgctgggattttgataagctacttggtaatagtaaattaaaaattttaaaataaagtaagggccgggcgtggtggctcatgcctgtaatcctagcactttgggaggctgaggcgggcagatcacaaggtcaggagtttgagacctgcctggccaacatggtgaaaccctgtctctactaaaaatacaaaaattagccaggcgtgatggtacgtgcctgtagtcccagctactcgggaggctgaggcagaagaatcgcttgaacccaggaggtggagccgagatcgtgtcactgcacttcagtgagccgagatcgtgtcactgcacttcagcctgggtgacagagcaatactccatctcaaaaaataataataataaataaataagataaattagttctgacttcaaatcaatctcccaaataacttccacattgattattcttaaatgcgagagagacagagagactgagaaagagagaggtaatgagaaagggtgagagagagaatgagaatgaaaaaacagaaaaaaaaaagcacaagaaaattataatactgatgtactacccaggaagagctataaaaatgttaatacaaccaggattaagaatatgagctaaatcttacatgctcttcccacacttttttttctctctcataagcctcctttctctttcgttctagttgttcttttagtacagcagcacgtgcatttgcatgggcctaaaaataaaaacaattaacaaaatgagttaccagaaagaagggcagaggtttttttttttttttttgggccaggtctatgaagatatttacttattagccaaaaaagaagtgtgcatgtggtcttagaataaaaatgtaagctcactctaaatctctagcacctaaaaccagccttgacatacagcaggtgttcaataaatatttgctgagtgaaaataaaggcaggtatatttgaatgtgaaaaaaatgtaaaaatttaaaacaattattatacacagacttcatttgccttcatggggatgtatattcgtatattttttatttttaaggttaccatttttttcaagattacttatatgatagtttcatgtatttatgccatggttttatctattttcataaacataatacaaaaagagaaaaatactatttttagaaaccaaaaagtggaggagaaagatgaaagaaaaattaaaggaagagactaaagtgatataactatgcaaaacttaagaacacaatttgctatctcagctttcaattttctctaagaaaacctgtatcatttctagtctataccttcagtgattcgatttttttgcgcctcatgtcagcctcttcacttccttcttgtccttcagaatgattagcttctttctacaaaataagtagataagcaaatcacttaggatagaatcatcaaattgagtgcagagctctgtgaaagataacaatgaataaactaaaatctaaaaatataaaatggaaatcatttaatgctgttagttttctcctaaagctgcaactgaactctccaccactatcagcctttcagaacaatggaacaaaaagataatgatataaaatgcattttaatcctcccatgaatactagttatattttcctctcagaatttctctggaacaaatggtcttatcaatttaaaatcacatatataagatttactttatgtgtagttttttgatctttgaacttccactgtcgtcatcagttttgttgttgttgtcgttgttgttaatggcacagcattttaaatgttaacctactatgacatcattcaatttcttcaaaaaaatagcttttcaacctaccttttcaccacgaagtttggctttaatctgttggcgctcattgaaattctgtagtcttatttgcctcagtcttgccagataaacctacaaggaggcaaaaaccccaacataataatgtaaaagcaaagctattgacatttttactgctagattttttttaaatttaaggaacagtgttaatttgaacacaagaaataaaagttctgaaatccggttaatggaaatgtaatattagctttcaagtgtttaattaagaacaatttatttctgaaaagaaagaaatacattataaaattacaaatttttaatttaatcaaaagaaaagaaactgaaatcataatattgaataagttacggggcaaaattataacacagaatgtcagtcaaaaatatattaacaggtccctacagacctacaaaatcttcaaataattgttaagaatttaaaccatgcaagaaaagaaggcaataaattcaaaaatggctatgtgatggaggtagcgaacatgcgggaagcatacctcttcctctttgtttcttggcttccctcctcttgaagagctgggcctgcctccatacatagctgccaggttttgcaggattccctgtttatcatttaatgtactaagtttaaagaatgactaaggctacattattatcttaccaaggaatatccaggtgctactttatttcttttggcaaatactgaccatttattgatgataaactgtgataacaaaccctggcgttttcctatgtcaacttgaaatatatatttagtgagaacagaaggaagcaattaagccccaaacataattattcaaaacagagaccagctatctttgtgttagtcacttaagaggggttttttttgtttgcttgtttgtttgtttgttttaaatcactgctttggaggttaaaccccaaaccaaattttcctctacaaacagccaatccatttcgacatatgtctatatatatactaaacacatacaaaataagatatttgagatcactttttctgaattcaacaaatgggttgtatattaattaagagatctcaatcaaactctgtgcactcaggcatgttcagttactatacagcaaatgttcaaacccaatcaaaaatggactcatttttgaacatagtttatatatttctcttccttcagcatacgagcatgcttcgacttactcccttaaaaaaaactctttagtcccactttcctgtcaaatgtctttttattggcttattgaatgtgtattttttttattcatcatctcaattttcctgcttcccagtcattttttagctcactacaatctagtttctgatcccattatgactgaaaattttctaaggtcaccaatgactttctacttcacaactgaaatgagcccttctgagtgatttttgcatttaacatttccactggaaattagttttgactgaatccacttaatttatatatgcatttttttctgtcataacataatacatactcattatagaaaatttattaaaaaataaagaaaatgtgaatcatttataattctgccatctgagaaacttaaaatttgagggtactgtcttccaaatttccttctctgcatatgtataatacatacatgtttatttttataaaactggtattttactagttatccagacaatattatatcctgaatctcttcccacatccatttaatattccttacaaacactattcttaagtgactatatactattcataacactccactatacaaatgttctataattcacacatttttaaaaagtctctcttctctttcagtatttataatggcactctctcttgggttctttcaattgtcactatttttcacaggcttttctctccttggcttgttgctgaatgtcaatattttctagagtttcatttgctggccctccttctcttctcatccccaggctttaacatatgctgccaattcccaaaccttgcagcccttttctctttacagctttctgtgtatgttaaactgacatctgggcaactccactcttacgcagcaaagctacctcaatttataaacctgactttatccttctttttactatataatcttattcccaattcagttattgaacatgatcagccactcaagtcagcaaactaggaattacatttgcctcttacctactatactcaaatatgccaaattaccaattctatctcctaataattctataattgatcatttcagtttctgccttagctcagcctctcttcttttgactcttaaattgctaaatgagtttcccaactcatcctacctctagtctcacatcccacaattccattctctacaatgccctgagagtaacctttctctttcacatcaaatcccacacaaatccttcaatggttactattatcttcagactttaattcacattctgttgaatggcaggtaaagccatttgtgatctcgccatttctagtctcatctctgccactgctcagtcataaatcctacattctggctacgacaactacttgtggtctgtaaactgtaccatgatctcactcatcctcttaagatgggtaactctactcatcttccaaaactcaaaccaagtatctcaccccagaagcctcttcaaagccttctctagggagttaagtgtgcttcctttgaccttccataccatttctttatagaaacctctcacagtagcactcattagagtgcattataatggtggaagcgcagtatattttagttaagaacatgaaatacagactctgaaatctgtttttgtcaacatcacataagcactgttgatcttaaacaaaactgcttaaacttgttgttaagtctaggcataaaaacacctacttcttgggtgtaccagagcaaaaaagtattactgtaagagcatgccctaccttttttcttttgcagcatgacaaagcacctttactcactcagtttcctcccctcttcaagaaggcccttgcaatagcttatcagtatttgagcttttgagatatatataggtcaaagagttggggagatgaaggaaaataagaaataagcagcgctgggcaaagatgtgagataaattctgaaaaggcatatgggagtatctacaaagttaaggggagtgggtggtagtgaattgagtattgctatagatgataacttcctttcatgatatttgagaaatgcaagaatctgagttactctgaagttttaaaacctttttggtttgaaatattatagatatacagaaaggtgaaaagaatatacagggaggtcctgtgtgccccttcacccagcctttcccaaatttctcatcttgcatagctacattacaccatcaaaaccaggaaactgacattgattcaaattatagatataatcttttatttgtgccgtgcatctacacaattttgtcactcatgtcatcttatgttaattccaccctaatcaagatgcttagctgtattattactggaacacttcatagccacattcactacctccatccctaacccatcgaccattaaactgttctccatcttgataattatgtcataatttctatatagactcacaatatgtgtccttttgagactgagtgttttcattcaatataattatatatggtccatctatggtattgcaatgcatcaatagttcattccttttcattgcaaagcagtattccatggggtggatatagtgttatgatacagtcttttcattcattcacccattaaagggcatttgggtagttttaagtttttttgctattacaaataaagtttctatgaatattcatgaatgagtttctaagtgacaacaagttttcttttctctggaacatatgcacaagaatgaaatcgctggttcttggtatgaagtccatttttagtttaaaaaggaactgtgaaactattttgcacaatggctgtatcattttacattccaaacaacaatgtataggtgaccagtttcttcaaaacttcatcagcatttggttttatcactatttttttattatagccattttgataggtgtgaagtgataacatcattgtggtttaagtttgcattttccaaatgatttgggtatctcttcatgtgttacctgccatatgtatatcctctttggtgaaatgttttgtataaattttcctcattttctaactggatcttttatgtttaatgttgaattttgatacttctttatattttctaaatataagccttttgttggataagtgctatacaaacatttctctcaacctgtaatttgtattttctttctcttaacagggtcttttgcagagccaaatttttaaatttggacaaagcctgctctatcagcttttccttttttggattatactcttggtgtcaagtctaataactctttgcctagtactaggtccccaaattttcttctctttttactagaagttttgcagtttcatatgaaagcccatgatctgttttgaggtaattattttatatggtttgaggtttaggtcaaggttggtagagcttatggatgtccaattcctcccacaataatattgaaaaggttactcctactccactgaattgcttttatgtgtttgtcaagaatcagttaggcatatatatttgtgtgcatctattctgggactctccatagtgtttcattgatctatgtgtctatccctttgccactactatactgttttgattactgtagctataagttagcctcaaaatcaggaagagttattcttcccaagttgttgttcttcaaaattgttttagttactttaaggtctttctctttccatataaattttaaaataagcctgtctatattaaaaaatattttctgagattttagtaagaattgcattatctctccaatttaacaagaattgccatttttactgttgtgagtcttctgattcataaacaatgtatctctccaagtatttaggtcttcttagatttttttcaccagcattttgtcatttaattgcatttaatattgcatatgttttgttagcattctttttcacattctttggaacaactgtaaatggcattacattttttgtatcagtttccacttgctgtcaatatatataaattcaattgatttttgtgtactgatcttgtatcctgcaactataatgaattcactttttagtttcaggagtatttttgtagagttctgggaatttcccattcagataatcattatcaacttgaaatagcaacaactttatttcatcttttcaattctgtatgccccttcttgctttattgcagtaactacaacttacagtacaatgtcaaatatgagtggtaaaagttacatgcttgcctgttccctaattgtagagggaaatccttcagtcttctacctgtataatattagatgcagggtttttgcagatgcctattgtgaggttcagaacattcccctgtatttctagtgtgctgacagttattatttttttaaatcatgaatgggtgctgatttttttcaaaagattttctgtatcaattgatgtaatcatatgaatttccttctttagcctgttgatatggtgaatcacattgattttttaatactgtaaaatacttgtacatctagactaaattccacttggttggggctggatataatttactaaaattttattgaggatttttgttatttatttatttatttatttatttatttattttttgagacagagtcttgctctgttgcccaggctggagtacagtggtgcaatcttggctcactgcaagctccacctcccgggttcatgccattctcctgcctgagcctcctgagtagctgggactacaggcgcctgccaccacgcctggctaatttttttgtattattagtagagacagggtttcaccatgttagccaggatggtcttgatctcttgacctcaggtgatccacctgcctcggcctcccaaagtgctgggattacaggcgtgagccaccgcacccggcaaggatttttgtatttaatttcatcaaagatactggtctgtagtttgcttttctgtgctgtctttggttatggtattagggtaatacagtctcaaaatgagttgattagtattcactccactactacttctgggaacagattgtagtgttgtatcaaattggtgttaattcttctttgaatgtttggtaaaattttccagtgaaaccatctaggcccagagattttcaatagtttttgaatcacgaattcaacttttaaaacagttataggaaaatttaagatatctgtttcaacttggctaagttttggtagtttacgaattttataggattggttcatctcttctaagttgttgaatttatgaatgtaaagttgaatttatccttttaattgttacaagatctataattatacccatttttttctgatattggtgatttgcgtcttttttatctttgtcaattttgctagagacttatcaaattcacttttatgtttctaagagtcagttttttgtttcattacattactctatagtattactggtctcaattttatcagtatctattcttaattacttcattctgcttgatttgggaatattttgctcttttttttcctagtattttgagttaggaatttacagtgatttgagacatttcttctactgtctgcatttagtgctataaatttccctcacagaagtgcttcagctctcacacatttttgtgcgttgtgtgtctatttccattctgttctatgtacatctaaatttcctttcagatttcctctttgacccatggtttatttaaaagtgtgttaatttttaaatgtttggagattttcctgtcaccttcctgctactgatttctagtttaattccactgttctctatatttgtaaaggttttataattcagtatattatcttgatgaatttttgatgggtgcttaaaatgtgtattttgctattgtggagtggaatattctgtaagtgcaaattagatcctggtggttagtgatggtgtttagctattctatatccttgctgattttctgtctagtagttctatcaattgctgagagcaggatgttcaagtctcaactgtaattgtgaacctgtttacttcttctttcagctctattagtttctgctctctatattttaaagtatggttatttggtgtatacatatttaggattgcaataacttcttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctattcctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtcctttgcccagtttttgatggggttgtttgtttttttcttgtaaatttgtttgagttcattgtagattctggatattaggcctttgtcagatgagtaggttgcgaaaattttctcccatgttgtaggttgcctgttcactctgatggtagtttcttttgctgtgcagaagctctttagtttaattagatcccatttgtcaattttggcttttgttgccattgctattggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacaatattgattcttcctacccttgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagcgttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctatgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttaatagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtagggatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctcagttctagtttgattgcactgtggtctgagagagagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgtggacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggttattttgctcattagttgatgcagtttcttcctagtcttgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctgtatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtctgggagttgctcttctcgaggagtatctttgtggcgttctctgtatttcctgaatctgaacgttggcctgccttgctagattggggaagttctcctggataatatcctgcagagtgttttccaacttggttcccttctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgcgcttccaggctgctttgtttacctaagcaagcctgggcaatggcgggcgcccctcccccagcctcgttgccgccttgcagtttgatctcagactgctgtgctagcaatcagcgagattccgtgggcgtaggaccctctgagccaggtgtgggatatagtctcgtggtgcgccgtttcttaagccggtctgaaaagcacaatattcgggtgggagtgacccgattttccaggtgcgtccgtcacccctttctttgacttggaaagggaactccctgaccccttgcgcttcccaggtgaggcaatgctcgccctgcttcggctcgcgcacggtgcgcacacacactggcctgcgcccactgtctggcactccctagtgagatgaacccggtacctcagatggaaatgcagaaatcacccgtcttctgcgtcgctcacgctgggagctgtagaccggagctgttcctattcggccatcttggttcctccccctgcaataacttcttagtgcatgattcttttgttaccttgtctctttttatctctttgtccttagtaacttaattttgctctattacaaacaaattcttttagtttcctgcatttgagagtgtctttatttctacttcattccaaaaggacagttttggtcagatatagaattaaagattgatagtactttttcttctttcagcacctgaaaaatgttgtaccacttccttctaaactccatggtttcagatgagaaacctgctgttattcaaattggtgtactttcatatggaatgtgtcatttctctctcccatttttcagatttgtctttttaaaaacatttcttagtgtggattcgagtttatcttattgtaggatttgctcagcctcttaaatctataggtgagaaattttcagtcattatttcttcatttttcggtcacatactttctcctgtcctttaagctttgaagatacaatgttaaatttttgtattgtcctataaattcttgggactgataatttcagtatttttactctctgttgttcagatagagaactgaactggtatgtcttcaagttcattgattctatcttctgtcatcatctccactgtactactgagtctaatctgtgaatcttaattttgattattgtgtttttcagttctataatttccatttaattcttccttaaaacttctatttgtttgctgaggttttccctttttatcattttaagataatttaagataattgattgttgaagcatttctatcacagcaactttcaaacccttgtcaggtaattcctacatctgattcatcttgatatgaatgtcaaatcaatgtcatttctcacacaaattgtgtttttgctgcattcagcttggtttgacaagttattatgttaaaagactcatagtcctgcttaatctattttatgcaggaagtagcctgtcaaagtttagcaatcggcttctagcctacttttgtgggctttagtttcaattgcagttcggttttctgaaaacttgtgatactcttctggtctgattcattcttctggtgcttccagagctcctgttcaatcactgctgctgctgtcttgtgagaatggaagttgcttctctgggctaccggctgttgctgggagacttccatggtggaggtaccatgaataagttgtggagtggggcagggatagcctgaggcttcaccactgtcctgagcttgaatcactcatcaggtccctggtgtcaggaaaatgttgaggttccctatctttgttgggattccccttttccagtcctttggtgagtaagagcaggcttttcttgtttaatattgttttttgtctagtggatctgggttgcaggcctctctaatacccagtccaagatatacgggagacagaaaacccagagaaccctggtgttatttctcaagtcccgaggtctctagccagctcaccttctttctggcatttataatccaattataattgtatgctaaataatttccagggtatttagttatatttagagggaaggaacagggaaaagtgagtctatgccattctttttggacctgggcagaaactactttttgatagctaaggtttttacactgcaacatactctataacatgactagcacatcaaagtttgacacagttacacaggattgttggaaagactaagagattgctatgttgaactgtgcccctcataaattcatatgttgaagtctcaaaccctagtacctcagaattaaccttatttagagataggatgtttcacaagttaaaatgaggtcatcagaataggtcctaattcagtaggactggtgtccctataaaaagggaaaatttgaagacagactcacacacagcaagaacacaacatgaagatgaaggcagagatcaggatgctgataatatacaccaaggaaggtcaaaaattgccatccaataaccaaaaggtaggaaggaggcatggaacagattctccctcaaagcccccagaaggacacaaccctgctgacacactgatcttggacttcttgccctgaaaactctgagataataaatttgtgttgttgacgccatttagtttgtagtcttttgttacagcagccttagcagactaatatagaggtaatgcatataaattgcttaacacgatgcctggcataataagctttcaataaatagttattattacttaattgttggtttattgtctatctccctttactgcttatatgttcctgctagcatgaaacctaacatattacagtcattaatttctgtataaaattaaatcaatgaaagaatgaatgaaaagttttaacagttaactgcacattttgtaaggtaggttttccattagtataaataaacacagtatgatttaagatgagttaataagaaagtaacatttctcaagggaaataatgctgtttcatcatttttgtaaaattcagaggttcttctgttaagttattcaacagaagataaccaagaaaaactcttgcacatgtgtaccaggatatatctacaacaatgttcaaagatgaactggaaccaacctaaataattactgtcaggagaataattgtggtacagtcacacaatggaatatcatacagcaatacttgacaatatgaatgaatcttagaaaaatgttgaatgggccgggcacagtggctcacttgaggtcaagtgtttggggccagcctgaccaacatggtgaaatcctgtctctactaaaaatacaaaattagctgagtgtggtggcgcatgcctgtaatcccagctacttggaaggctaaagcagaattgcttgaacccaggaggcggaggttgcagtgagccaagatcgtgccatagcactccagcatgggcaatgagagcgaaattccatctcaaaaaaaaaaaaaaaaaaagaaaaatgttgaatgaaaaatgtctcagtctatatacagtaaaatttttataatactcaaatcaaacagaacaaggtactgattaatcacgcatatgtgtgtgaaaaaagagtattttaagaaatctacaggaatgataaattcaaattcaggataatggctacctgcagggaaaggtggagaaaaaagatgaaataggggttggaaaactatggtccatggtccaaatccagcccatcacttgtttttgtatggtccaaaagctaagaatggtgttcaaattcttaatggtatggaaaaatgaaaaggatatttcacaacacatgaacgttatgggaaattctaatttcagtgtccataaacggtgtactggaacacattcatgcttactgatttacacattgtctacagctgcttttgtgccataatgcaaagttgagtagctatgatagagaccttatggccaagcaaagccacgaatgcttactatctggccctttacagaaaaatgtttgccaatccttgagttagggaagagtacagaggctacttattagtgttcaatcttctgggtatattattttgctttttaatttacacacatattacacatattcttttccatgtaccaaacattattttattttatttttattttattttgttgagaaagaatcttgctctgtcacccaggctggagtgcagtggtgcgatcttggctcactgcaacctccacctcctgggttaaagtgattctcctgcctcaacctcccaagtagctagaattacaggcacgcaccaccatgcccagctaatttttttatttttagtagagatggggttttatcatgtttggccaggcgggtctcgaactcctgacctcaggtgatctgcctgcctcagcctcccaaagtgctgggattacaggcatgagccactgcacccagcccaaacgttattttagaataataaaggaatatttttaaagaagatctgaaaaaaataatcttttcaaaataaacttagcgttgaagaactaatttactatacaggataatctatagcaaagatcagcaaattattatcaacaagtcaaatctagtctgctgtcttatttccaaaatcaagctttactagagcatagccacactaatttgtttagccttttactactatggtaagagttgaacagttgtacaaaacaccatatggtttaaagcttaaaatatttactctctggccttttacaggaaaatatctgcctgcccccactttgcaatgctgccttatctacaagttttacctaaactaaagcaaacagtaatatgccatttaaaaaggaacaaacaacatagtcaaacagctaaaagcataatcttgagagtcagacattctgggtttgcaccctgtttctgggcattactacgtgatcttgggcaaagtactagtaactctgggccagttttaaaaccagtaacactggaataaaaatccccactacaaagaattactatcaggagtagattttcagtcattttaattaattttattaataaggttcagagcaaacccaccttccctctgacacacacatacacacgaaaccaccaccaacaaaaaacatgtggcttgaagtcttcttgatagagtttccctaaactgcattttttgtttcaaagtttcagttacctatacagggaaaattttaaattcatcaaaaagcatgagaccagtcacaatgggtcatgcatgtagtccagtattttggtagactgacatgggaggataacttgaagctaggagtttgaggccagcttgggcaacacagcaagacctaactctacaaaaagattaaaaaattagccacgcatgatggcaagcacctatagacccagctactcaggaggctgaggtgggaggatcacttgagcctaaaagtgtgaggctgcagtgagctacagatttgcaacactgcaatttaacctgggtgacagagggaaaccccgtctctaaaaaaaacaaaaataaaagtaaacaaaagcacataaaattattttgaaatacacgatttctttaaactataattcaacctaaaaactatttacattttcccatagaaacctgttttaattcactgtggtttcccaaagcagttaataaatatactgttcaaataacttgactatagcaggttactaattccagagggttaatccttcagactcagaatttaatcataattgttcaggcttatttgatattttaaaatatcagaaaacacatattgggtttaagacctgaatctgttagaacctctttaaaagctttacaaacctgtgggagaaaaacaaaaagtctaacatttcatgccatcagagaaccagaagaagagaaagagcgcagtgttggaaaaatatttgaagaaataatggcttaaaacatgacaagtttggtgtaatccataaccttgtaaattcaagaaactagcaaaccataaatagaaaaaatccccaaaaatccatttccagagatgacttaatcatactgctgaatactaaagacaaagaaaaaatactgaaagcgtccagaggaaaacaaaagattaactacaagagaaaaagcatttgaacattcaggtgagaatttctcactgaaaactatggaggatagaaagccagaaagtaacatttttacgtgagaaaagaaatatgctgtcaaccaagaatattacatcctgtgaaaacaccattcagatatgaagatgaaatagacattctcaaataaagtaaagaaatctacagtcagcagacctgatctctaagagctgctaaacgaatttctttagggaaagggaaaaagaagaaaacttgaaacattaggaatgaaagaaaagtaatagaaataagtatttgtataaatataacaaagtattccttttctctgttattaaacatgtctgacagttaaaagaaaaggtataacatttcctggtgttattttaatgtctgctaacgtaatacaagacaactataccataaaggggagagggtaaagctactatgttggaaagatttctatgttccaactgaaatagtacaatattgtttataaacagattgtaaaaagtaaagtatgtatttttaacccctagagcaaccacaaagaaattatacaaaagaaaaatatagtcaaaatcacaacagattaattaaaatggaatattaaagtgttcaaataatctaaaggcagcagggaaatggaaagagagaaacaaaatcatagggtataaacacaaaacaaataatagaatgtgagatgtaaatcctaacatatcaataattacattaaacgtctttaagtataataatgaattacttaaacacaccaatgaaaagataggaattgttagactacattttttaaaaacacataaaaaaactataaattcactataaaaaactcacctcaaacaatcattcaggtaaattgaaagtaaaaggaaacaagatataccacacaaacagtacacgacagaagctggaatgggtataatactataaaaaaaattatcttcaaaccaaaaaattaccaaggatatgccttactgactataagatggcctccatgatgcccagctcctaatatttataatattgtaaaatcccctcctgagagtgtggggaggacctgtgatttgcttttaaccaacagactatgacaaaagtaatggatgtcactcctgtaattgtcacattatataccattctgcccttgctagcatacaccctccacaggttgcctttgcttgataaagcaagcagacatgttgaagaggcccatgtgtcaagaaatgtctctacaaatgcaggtggcccctaggaactgagagagacctcaagtcaacagccagcaagcagctgggacccttgttcattaagccacgaggaaataaattctctcactaacatgaaagagcttggaaataaatttttcctcaaatgagcttctagataagaatgcatactggctgaccatattacagtcttgtgagactccaggtagaagatatagctaagctgtgtccagactcctaatccacagaaactgtgagataaactgctaaattgtggtaacttgctacactgcaaaagaaaacaaagaaagaaaaaactgacagaactaaaaggagaaacagacaaatccacaattatatttgaagacttccttagtatcaaatagaatgtagataggctatcagtatggatcaagaagaataaaacatccaccaactggatctaataaaagtaatattccacccaacaatagcagaaaaccattccattcaagtacatgtggaacattcactatgacagatcatacactagatcaaagtacaaaccctaacaaacgtaaaaggactaactgaaatcctacgaagtatgtcctatgaccaaaatgaaataaaaccagaaaacgacaacagagataataagaaaattttcaaacacttggaaattaaacagaatacttttacgtaatccatgggccaaagacgatatctcaagaaaaattagaatacattttgaactgaatgagaatgaaaacacaacatagaaaatttgtagaatatggctacagcaacgcttagagggaaatttataaaatgcaataccactatcagaaaagaagaaaggtctcaactcaatgttttaagttgctacctcaaaaaacaagacatcacaaattgtatgcttatatcaaaatatcacatgtaccccatagatatgtataactattatgtatcaataaaaatttaaaaacaaaaaaaagagcaaaatagaaatcaaggaagacaacattgtgaatgtacttaatgccactgaactgtatactttaaaatgattaagggagtacattttatgttatgtgtattttattacaataaacgtcttcttcctggatcataaatctaaaggtggaaatgaaaactataaaaactttagaagaaaaaataaaaaatcttcatgattgttggataagctgagttcttagacataacacgaaaagcatgatccaaacaaaaaaattgacaaactggacttcatcaaagttaaagcctcatcctctgcaaaagattctgttaagggaatgaaaagctaagtttcagactaggagaaagtattggcaaatcatttatccaatataagacttgtattcagaacatataatagaactttcaaagctaaagaataagaaaacatacaattaaaatggacaaagacctttctctaaaaggatataaggatggcaaatatgaaaagacattcaacatcattaacatttagagaaatccaaattcagccacagtgacatattcctatacatggtttagatggctaaaataacactgacaacaaatgctgatgaggatgcagagcaactggaattcgagtacaatgctgatgggaatgcaaaatgtttgaaacacttttggaaaaaagagtttttaaaaaatcaagttaaatgtacacttacaatatgacccagcagacccactcctgggtatttatcctatggaaataaataatcaaaacagctctattcataattaccaaaaattggaaacatctcaaatgtcccacaactggcaaatggataaacaaactgttgtacatccattcaatggagtactactcagcagcgaaatgaaacaagctatttatacatgcaacaacttgcatgaatatcattacagtgcaggaaagaaaccagtcacaaaaggttacaacataccattacgtgtgcagacagtttcccacttatgatagtttgacttatgctttttcaactttacaatggtgtgaaagtgacaagcattcagtagaaaatgtaccttaagtacccatacaaccattctgttttccactttcagtacagtattcaataagttatatgagatattgaacactttattacaaaatagactttgtgttaaatgattttgcccaactgtgggctaatgtaagtgatcttagcatgtttaaggtaggccaggctaagccatgttttgtaggttaagtgcaataaatacatttttgactaaatattttcaatttacaatagtttatcaaaatgtaaccccatcgtaagtcaaggaacatatgtatgtatacatacatacaatttacaagacactctggaaaatataaaatggttgccaaggtgttgggggtagaacgagagatgtgactacagaaagatagcataagggttggcggggggtgatggaattgttctgtaacttgattgtggtgctggctgcatgaatttatacatgtgttaaaattcctggaaaaaagtctatatcactatatgatcatttgaaaataaaatatgcaaaaaatgaggtgccagtgcaccacctgggaaacaacattcggaaggcaactagataaacaggacagaagttaggagagtcatctgagttactgatatagattttcaagtcatctggtagaattatcagtgagatcactccaggatattatttatagtgagaaaatagcaaggacagagctgcagagaatattggcatttaaagactgagaagaaaataattctatagaaggcattaagaaattgtagccagagaaataaagggtaaatcaagagaatgtggtatcgtggaagaaggaaattttgaagtagtagttcatgatcaaatgtcacagagcggcagagtaagatgaggattaaaaatagtctattatatttggcaagatggatagcagtgacttctttgatatgatgataaactattaacaataaattgaaaactaaatagtagataagaaaggagagacagcaggtgtttcattcatttgaagagtctggctatgaacaggaggaaagagacaggatgataactacagacgtatgcagagttaatgatgtgagaaatttgaaaatatatatactacatacatatatgtattacatatatattatgtatacatatattatatatatgtatgtgtatatgctataggagagtaccggtaaagaagcaaagtcgaggagaaactttcttaagcagataagtgatggaataaggcccgaaagtaagagatggtatggcatagaatagaaggaaatggctgaaaccagagaaacagacattattaatcatcatagctttaattttctccagcagtgttcagaagtctaagtgtagtaacagtcactagttcagttacacataacgaggagggatatgctaactcagaaaatagggttccatagggaagacaggctagccaattatataggtatgtatataaataagtgaatttaatgatcacataaatccgatgagctttaaaagcatctattttggaaacaacacaaatgttcatcaacagagaaattgaacaaaatgtggcacatccatacaaaggaatatgacttaggaataaaaaacaactaactagtgataacactccagtcacaagaaaactatatactgtatgattcataattttatattaaattctagagaggacaaaactatagtaacaggaaatagatcagtggttgcctacggctgatggcggtgagtaggtgactgacttcaaaggggcatgaagaaacttttaggggggcaatggaacagtttacatatgatgatggtggcggctacgtaactatatatatttgtcaatactcattgagatatacacttagaattttattgcatttaaattatatgttaataaagccaattataaaaaaaggctcttgtatggtagcctgggttactatgttctaacacgaagtatgttgctaaaaacagcacttaaaagtagctcctcttagggcagagaaacattacagtgtatgacattacaatggtgataaataccattatatatttgtttaaatccatagaatgttagcaccaagagtgagcggtaatgtaaactatggactttgagtgataatgatgtgttaatgtaggttcgtcaattgtaacaaatgtactgctctgctaagggtggtgataacgagggaggctacacatatgtggaggcatgaggtatatagaaaatccttgtacttttccactcaattttgccacaaacctaaaactgctataaaaaataaagtctatttgctgggcatggtggctcatacctgagtggctcatcccagcacttagggaggctgaggagggtggattgcttgagtccaggagattgagaccagcctgggcaacaaggtgaaatcctatctctactgaaaaaaaaaatatgaaaaaaaaaattagccgggcatgatggcacgcgcctgtagtcccagctacttgggaggctgaggtggaagaatcaaccgagattgtgccactgcactccagtcagggagtgagtgagtccctgtagaaagaaaggaaaggaaaggaaaaaggaaaggagaaagggaaagggaactaaaagaaaaaaaaagagtagctcctctacttagtctaatctactgtctccagatgtaggctctaaaattataagcaaagggagtatagtaggcagaattctaaggaaacttccaaggtttctgttatctccctgtactccattgggtcaaccctgcataattcccaggactgtgaatatgacagattttgtgttaaatgcaatgactgatgttaacataaagagattatctggtgggactgacctaatcacctgagccttttaaaatcatagtcttctctggctggttgtagaaaggacagaatatcagtatgtcccactcatccttcactctcactgaaaactgcagagaacagattgtggcactagcacaatgccatcttcccagggagtcacccaaacaaaggcaatgaacagtaaaattcatactcccaatcatgaacacactagcaaaggtgcagaacatttgaggagtaccaacactatgaaatacctaacaaactttaaagtggaagaaaccaaagtaacatagtcaacagcacactaagaacaagactttacaacaattatatactaccagcgaaatgaaaacataagaaaagagttctatgggaaaactaattagaattcatggacatgaaaacgtaaatttttgaaataaaaggaaactcattagatgagctgaatggcagagtagacaaaaccaaagaatatattccagtgagctggaacatcaggcctagaaatccttccaaaacacagtaaaaagagagaaaaagattttttaaagtacattacatgcagaggttctaatatatcagtctaataggagtcctcttgaggagaaaatgtagaagcaatatttgaagaacttttaatttcaaatgtccctagaattgaagataagtactcacattgaaagcattcagtggaaacttaagccagtaagacaaaacaaaacaactgagaaatattcaagtgaagttcagaacgtcaaggacagaaaaatagtcctaagagttatgagaaaggaaagaattccttataaaacaacaagatccagaacatcacatgtctcattagcaacaatgtaagtaggaagataataaagcagaacctttaaagttctatggaaaataaacttcaaacttatatttccttatccagccaaattatcatttgaggctcatttgcatccataatgaagtaacagatctaccctcccatcttaaacactaaaagtctgaacaaagcatatgaaatggttttcaaacactggacaacagacagcacaggagagtgatccttgagagaagggaaacaaaggtggtaaacccaacagctgcccaccttactgactggcaagggtttcctggctgcagcacagagagaaggtaaccaaacagagcttggcagtccccttagttgaggaaacatcattcagaccttggaaaattgaagaacactcaaatttccaggacagagttgcaaagaagaaagagctgcacgggggaagggtgctcaagatctaaagagggtccctagagcttcctgctaaatgacaaacagcatattgtcaataatacctgaggttcaatcagggctgcaaatgtctcatgtttccaagagccaaactgaaaagacctccaaatcaatgaagcattgggtattcaaaagagtagtgctatagcagtgaggccaaattagcactgaagactgttctgtactggcctggccaaagcttacaagcaaactttgaaagactcaaactatttccaagtaacttaactgcaatcccagaaaaaagtccacaaatatttataaaatacgcaacgcttggtatccaactacaaattaccagacatgtaaagaaaaaaagatgaccctaattaggggaaaaaatcaatcaacagagactcagaaatgacaaagatggcagaattaatagataaggacatgaaaactgctattgtaattatattccgtatgtttaacaacatgaagaaaagtgggggacatggaaggtataaaaacaatccaaatcaactttaacataaaaaattcaatctctggctgggcacagtggttcacgtctgtaatctcagcaatttgggaggctgaggctggcagatcacctgaggtcaggggttcgagatcagcctggccaacatggtgaaaccccatctctactaaaaaatacaaaaaaattagccggctatggtggcacatgcctgtaatcccagctgctcgggaggctgaggcagaagaatctcctgaacccaggaagcagaggttgcagcaagcggagatcatgtctctgcacttcagcctgggcaacaagagcgaaaactctgtctcaaaaaataaacaaacaaaaaccaatttctgagatggaaaacatataatgtctgtatagaattaacagacacagcagaagattaatgcacttgaagacacagcaatagaacaacccaaaatgaaacacacagagaaaaaaaaaaagactgaacaaaatagggagcatcatcagtgaatggttagtagtgtacaaactggtctaatatatgtgtaccagagacctagaagagggagagaggcaaacagaaaaacattttttgaggaaataatgggccagacgcagtgggctcacgtctgtaatcccagcactttgggaggccgaggcagatggatcatctgaggtcaggagtttgagaccagcctggccaacaaggtgaagccctgtctctactaaaaatacaaaatattagcccagcgtggtgacagacgcctggaatcccagctactcagaaggctgaggcaggagaatcacttgaacccgggaggcggaggttgcagtgagccgagactgcgccactgcattccagcctgggcaacaagagttaaactccgtgtcaaaaaaaaaaaaaaaagaaaagaaaaagaaataatggatgaaaaatttccagatttgatgaaaatcataaaccacagatctgagaagctcaatgaacccctatacaaaataaacatgaagaaaactacacaaggcagggtgcagtggctcatgtctgtaatcacagcactttcggaggccaaggcagatggatcacctgaggtctggagttcaagaccagcctggccaacatggtgaaaccccatctttactaaaaaaatacaaaacttagatgggcgtggtggtacacacctgtgatctcagctacttgggaggctgaggcatgagaatcacttgagccagggaggtagaggttgcactgacccaagatcacgccactgcactctagcctgggtgacagagtgagagtttgtctcaaaaaaaaaaaaaaaaaatacacaaaccacatcataatcaaattgattctagtgataaagagaaaaattttaaagtagagaaaaaagatacattatataccaaggaaaaagataagaatgaatgcttagttcttgtcagaaacagggcaagccagaggtaaaaagtttcaactataatacaatatccagtcaaaatatttgttaacaacaaaagcaaaatactttttcagacatacaaatgctaatcaaattcaccagcagaccaccattacaaattatcattcaagcatgaggacaaaataagagcattttccaataaatcttggaaagttcctctaaaaaaaaattaccagattctccagcatgaaaaaaaataaactgaggggggaatagtaagacataaggaatgatgttgagaaaataaattagtaaatttcagtaagcctaccaattcttttaaaaatattttaagtaaaaatctataaccaaaattccagctgctattaacatgggagatatgagcaaaggaaaaggctggaggttctcatctactatctagaggaaagatacaaatatagattaattccggatgtagaaaaacaaatttaagtatctgtgttaacaatataaagggtaactgttcaaaaattttaactatgtttctatgacattgtttcaaagaaaaaacatactatattgaactacattaactcacaaagataccacttacgaacttacaacagatatgtaataagtctaattaaaatatattaccatctaattaacctatttcttatatgagtgtgctgcttcatgggttgctgagtggacagacataatcatcagttgttctgtagacaaaatgtcaaaaggcatttgtgaacctctacaaatcaaactatgaagagttttaactacctcaaatcctgttaaataccaaagagaaaacagagttttaatgattgaaatgattacctaaaaacttaatattttcttggatacataacttaatttagttaaatggcataactggagactttactaaaattctacttctaatttgcttttgagcaaatgcatagtttacatatatacttacccaaatacttatttcccatttttcttctaaaattctttgccacttaaaagtatgtaaaaccaaaagcatattggggaaaaaaaacatgcagcaatccaagaacttatttctttatctgggttgctatacccatttctactcttttaaaggaaggatacaggtatgaacttactcccaattaaccaaagcaacaatagaattccacccctggtataaaagatagcaaaagagaaggtaaatgagttaagatatcacaattttatactctgcaaatgacttctgagtatctttactgcctcttattatgcctagattgttagactgtcattctttttacttacacttaccttattccagaccttcacttggaatactaatacattcaaaatctcagaaacaaacaaaattcataccatatgtccttcggctcgagctttattctgcatagcttcccgttttcgctgcaggaactcttctacttgtttagctctttctacagctagctgccctttttgcctaatttggacaaatcacaaagtcagccatcctgaacagaaaatattctaaaaagttaaaaattacatttatcctaaatttttttttcatttcagaatatgaaggctgatgaaacactatctctgtaatgaagaaatcactatatatatattgacatctactacctaaatcacattctttattattttcaatacaagtaaaatctataattctactctaagtcttcacaagatagtttcttttatatttatttgatctattctacttatttaaacatatacaattattttagatacacttaattacggaagaatctgagaagtttccaagtttatttcagaactctgtatcaaatataataagaatcttagcagcgaagtcaaataaaagcagtacagcagcaatttaaaaaattaacaaaaagaacaaatgctttaagtatgaattttcaaaaatacagtaaaaagctatgtttgaattccctaaatatcacaactataaaaaagtaaagtggatagattagggaaaagattaaaaacagttatttgttttaatcttttccaattttacttttgtgtctttctctgacaattatgaaagaatgtaaacatgctgatcttagactataaataaaaagtatcaataacaaacactgattaagcatctactatatattgtgttagttaccttgctaagtatggaagatacaaatataaataaaacccagccccagtaatcagagaactcatagcatggcatcaattgtagttaattttggaggtaaggaagaaagatgagcaagttgttggccgtgtttctacttgtattttggctagtaaggcacagaaacttcctataaagactttctttgggaccataactaaattatgtcctgaaaattacatgaaataaatctcagtctcctagtaagatttgagcacttctgattttcatataccaaataactgcttcttttacattctttggcaacgattactaactgaaacataaaaatatttgaaatatgaaactaagctgtaaaacctaaaaatctattccatcacataactatgaatgacagtgatctaaggttcatttacctcatgtagtacttaaaaaagattcttacgaaatttccatcatgggaattttctagaattagataatctctatagctggtttgaaggcctattactgttgctctcagatgtgtctgggtagctaaatcttaatctagtttcacatcgctaaatccagaaatccacttcaccaatgccatgttagcttgagtaggctgaacacaatgcctctgtagtgtacctgtgccatcccctaacagtcccattagccactggaaaattctgagattaataacgcatatctgttctgaatgcaatttatctcctgcatatatcaatgtaaggctatatcctactttgctatatagccccatttatataaggctgggcctaaggaaggcagataaaccttcaaatgtgatgctctgacatgagattaataaggtatatctggtcagaatgcaacttatttcctgtatatatcaaagtaggactgtaccctgttctgccacatccccatctatgtaaggctgggcctgaggaggcagataaatcttcaggagtaatgctctgacataaaattaataaggtatatctggtcgtaatgcaacttgtttcctgcatatatcaaggtaaggctgtattctgttttgctatagcccgtctacgtaaggctaggcctgaggaaggcagatgaaccttcaggtatgatgctcagacatgtcatctgaaactctatggttacagataaggcacttttggggggtcctggaagtttacaccaccacctgcaagtagacaagataggtgatctctctgctgtgtatcctgattgtatcaacttccttctctaacttttacggaagtaaagcatgtttgacttcccatcttaagatgctttctgtgtccagtgattgttagcctgaacttacaattggcataggttaaacagcggttgcacaaaattgtttactaagaacctggtcatctgtataacagctttgatttatagattttcacaccatttatgcatatataacactacttgctctatgtatttatatgatttataaattttgcttcattgaacagctgcttcctacgctggcttaaataagcaggtttacattactggctactttcaaacacaaacttaataactgtagtgcttttgtttaacactaattcttttttcctataatttattaaacaaatattgagtgtcaactatttgccacattatatctgccaaaagatataaagatgaataaaacagagttccagggaggcaaggttggttcaacatatgaaaatcagcgtaatacatatattaatagaataaaagacaaaatcaattttatggctccttacactgtttaaaaacctataaaatctgtgtccttatttttcatatgcattagtgtttactacttcacatacaccaaaaatagtccataacccacatgcttagtcctctctaaagtaatacaactctactaaactatgggtataaagtacgcttgtgctgggatcatggggattaagagaaaacagtcagtttacttcttgatagtaattttcttcattaaacactattaagaattcacgtgagcatgctctgttttacaaaaattagactatttcttttgagttccagaattataccacttaaaatcagtaaaacactgaccccgattaaggataagaggatgataatataaatgcaaatatagtaagaaattaggaattggatagtaaaacacaaagacattaaaatggactaaaaagtataatgtaacaggataagggacatcaaacaaagagataacagaagtatagtgttcttttatcaataaataattattccaagacaaactttcctttttttttttagccctgacaagagaaggggaggaaaagggagtaagttattttctttccttttcttattgtaaacacatgaataagcaacaagatttggctgggaactgcatgcctcacatccatggttcaaattctttactgataaagaaaatttaaaacttctcaaggataaagttgaagacaacataaaaataagtagcactctaggtaatggagataatctgagaaataaaaatgagtaatgtggtattgggcagaagagatggggtggtacaggattactgagatgaaaaaatgatgtagaagggtttattcatttagcttcctcttaaggggcatgtcgatgtaatggaacgaaactgttgttagttttatccaaattaaatgaagcaatacagacagaaggacttggaaaaagtaaaagcaccataaaaacacaaatgttaggtggcactctgtaatttattaaaaagtggcttcagccatttcaacagtacatggcttgagcttataatattaaaaatcctaacagaagaggtatgttattaagaaattgcatataagcaaaggtagactggtcagagttactgataagaaaggaagaggaaaaataactactaccataaagaagaaacaggcaaatataggtgattatgaagaaaagagaatctgaaagagtcttagatgcctacagatttcagtttgctgattcagtttgaatcatggaaaggaatgaatcaagaatgaaaatgacatacaaattataataatcagaaattgtgacagcgtgcagagaaaatgtcctataatgccagtgaccactaaacagtacaagacaaaagaaccattcagattggaagcaaccttcggtattaactagtccaagttttcattgaataaaatattcccatattcccatctaaatagcccatgacacactgtcatttcaacctttggttaatacttccagtttgaagatgttcattaaaccccacgatgatccaacctttgaacagtcctcatatctgaccgaaatgtgtctttatatttccaccctgggtctagttcctcttttacatgacaagtcagtcaattcttccaagtttgctcctttaaccatgatttctttaatgatggctaaattcccagactctttttgttttattacactttaagttctggggtacatgtgcaaaaagtgcaggttacataggtatacacatgccatggaggtttgctgtatccatcaacctgtcatctacattaggtgtttctccagatgctatccatcccctagcccccgaccggccccagtgtgtgatgttccccttcgtgtgtccatgtgttctcattgttcaactcccacttatgagtgagaacatgtggtgtttggttgtctgttcttgtgttagtttgctgagaatgatggttaccatgtccctgcaaaggacatgaactcattcttttttatggctgcatagtattccatggtgtatatgtgccacactttctttatccagtctatcctgatgggcatttgggttggttccaagtctttgctattgtgaatagtgccacaataaacatacatatgcatgtgtctttatagcagaatgatttataatcctttgggtatatacccagtaatgggattgctgggtcaaatggcatttctagttctagatccttgaggaattgccacactgtcttccacaatggttgaactaatttacactcccaccaacagtgtaaaagcattcctatttctctacatcctctccagcatctgttctttcctgactttttaattatcaccatttggtgtgagatggtatctcattgtggttttgatttgcatttctttagtgaccagtgatgaagagctttttttttttcatgtttgttgactgcataaatgtcttcttttgagaagtgtctgttcatatcctttgcccgcttattgatggggttttttcttgtaaatttaagttatttgtagattctggatattagccctttgtcagatgaatagattgcaaaatttttctcccattctgtaggttgcctgttcactctgatgatagttgcttttgctgtgcagaagctctttagtttaattagatcccatttgtcaattttatttttagttgccattgttttgggtgttttagtcatgaagtctttgaccatgcctatgtcctgaatggttttggctaggttttcttctagggtttttagggttttaggtcttatgtttaaatctttaatccatcttgagttaatttttgtataagatgtaaggaggggatccagtctcagctttctgcatatggctagccagttttcccaacaccatttattaaatagggaatcctttccccaccacttgtttatcgggtttgttaaagagcagatggttgtagatgtgtggcattatttctaaggcctctgttctgttccattggtctatatatctgttttggtaccagtaccatgctgttttggttaccgtacccttgtagtatagtttgaagtcaggtagcaggatgcctccagctttgttcttcttgcttaggattgtcttggctatgtgggctcttttttggttccatacgaaatttaaagtagtttttgctaattctgtgaagaaagtcaatggtagcttgatggggatagcattgaatctataaattactttgggcagtatagtcattttcacaatattggttcttcctatccatgagcatggaatgtttttccatttgtttctgtcctctcttatttccttgagcagtagtttgtagttctccttgaagaggtccttcacataccttgtaagttggattcccaggtattttattctctttgtagcaattgtgaatgggagttgactcataatttggctgtttgtctgttattgctgtatagggatgcttgtgatttttgcacattgattttgtatgctgagactttgttgaagttgcttatcagcttaaggagattttgggctgagatgatgggattttctaaatatacaatccatgttatctgcaaacagagacaatttgacttcctcttttcctattggaataccctttatttctatctcttgcctgattgccctggccagaacttccaatgatatgttgaataggagtggtgagagagggtatccttgtcttgtgctggttttcaaagggaatgcttcagtttctgtccattatgatattggctgtgggtttgtcataaatagctcttattaagatctgttccatcaatgcctagttattatttggaaagtagggctgttaaattttgtcaaaggccttttctgcatctattgagataatcatggggtttttgtcattagttctgtttatgtgacggatcatgtttattgatttgtggatgttgaaccagccttgcctcccagggatgaagccaacttgatcatggtggataagctttttgatgtgctgctggactcagtttgccagtattttattgaggattttcgcaacaatgttcatcagggatattggtctaaaattctctttttttgctgtgtctctgccaggctttggtatcaggatgatgctggcctcataaaatgagctagggaggattccctctttttctattgtttgcaatagtttcagaaggaatggtaccagctcctctttgtatctctggtagaattcggctgtgaatctgtctggtcatggtttttttttttttttttttttttttgcttggtaggctattaattactgcctcaatttcagaacttgttattggtctattcagggatttgacttcttcctggtttagtcttgggagggtgtatgtgtctaggaatttatccatttcttcagattttctagtttatttgtgtagaggtatttatagtattctctgatggtagtttgtatttctgtgggatcaatggcgataccccctttatcattttttattgcatctatttgattcttctctcttttcttcattagtcttgctagtgatctatcaattttgttgatctttaaaaaaaaaccagctcctggattcattgattttttgaagggttttttgtgtctctatctccttcagttctgctctgatcttagttatttcttgtcttctagcttttgaatttgtttgctcttgcttctctgattctttttttttttttttatactttaagttttagggtacatgtgcacattgtgcaggttagttacatatgtatacatgtgccatgctggtgcgctgcacccactaactcgtcatctagccttagatatatctcccaatgctatccctcccccctccccccaccccaccacagtccccagagtgtggtattccccttcatgtgtccaggtgatctcattgttcaattcccacctatgagtgagaatatgcagtgtttggttttttgttcttgcgatagtttactgagaatgatttccaatttcatccatgtccctacaaaggatatgaactcatcattttttatggctgcatagtattccatggtgtatatatgccacattttcttaatccagtctatcattgttggacatttgggttggttccaagtctttgctattgtgaataatgccgcaataaacatatgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagataatatctcatagtggttttgatttgcatttctctgatgaccagtgatgatgagcattttttcatgtgttttttggctgcataaatgtcttcttttgagaagtgtctgttcatgtccttcgcccacttcaaggagaactacaaaccacccaaggaaataaaagaggatacaaacaaatggaagaacattccatgctcacgggtaggaagaatcaatatcgtgaaaatggccatactgcccaaggtaatttacagattcaatgccatccccatcaagctaccaatgactttcttctctgattcttctaattgtgatgttagggtgtcaattgtagatctttcccgctttctcctgtgggcatttagtgctataaatttccctctacacactgctttaaatgtgtcccagagattctggtacgttgtgtctttgttctcattggtttcaaagaatttatttatttctgccttaatttctttatttacccagtagtcattcaggagcaggttgttcagtttccatggagttgtgcgattttgagtgagtttcttaatcctgagttctaatttgactgcactgtggtctgagactctttgttatgatttccattcttttgcatttgctgaggagtgttttacttccaattacatggtcaattttagaataaatgctatgtggtgctgagaagaatgtataccctgttgatttggggtggagagttctgtagatgtctattaggtccgctcagtccagagctgagttcaagtcctggatatccttgttaattttgtgtctcattgatctaatattgacagtggggtgttaaagtctcccactactgtgtgggagtctatgtctctttttaggtcactaagaacttgctttatgaatctgggtgctcctgtattgggtacgtatatatttaggatagttagctcttcttgttgcattgatccctttaccattacgcaatgcccttctttgtctcgtttgatctttgttggtttaaagtctgttttatcagagactaggattgcaacccctgctttttttgttttccatttgcttggtaaatattcctccatccctttattttgagcctacacgtgtctttgcacatgagatgggtctcctgaatacagcacactgatgggtcttgactctttatccaatttgccagtctgtgtctgttaatgcagcatttagcccatttacatttaaggctaatattgttatgtgtgaattagatcctgccattatgatgctagctggttattttgcccattagttgatgcagtttcttcatagtatctatggtgcttacattctgatatgcttttgcagtggctggtaccagttgttcctttccatgtttagtgcttccttcaggagctcttgtaaggcaagcctggtggagacaagatctcccagcattttcttttctgtaagaattttatttctccttcacttatgaagcttagtttggctggatatgaaattctgggttgaaaattattttcttgaagaatgttgaatattgacccccactctcttctggcttgtagggtttctgcagagagatctgctgttagtccgatgggcttccctttaccggtaacctgacctttctctctggtggctcttaacattttttccttcatttcaaccttggtgcatctgacaattatgtgtcttggggttgctgatctcgaggagtatctttgtggtgttctctatacttcctgaatttgaatgctggcctgccttgctaggttgcagaagttctcctggattatatcctggagagtgttttccaagttggtttcattctccccgtcactttcaggtacaccaaacaaatgtagatttggtcttttcgcatactcccatatttcttggaggctttgttcgtttcttttcacttttttctctaatcttgtcttctcgctttatttcattgagttgatcttcaatctctgatatccttttccacttgattgattcggctattgatacttgtgtatgcttcacgaagttctcatgcagtgtttttcagctccatcaggtcatttatgttcttctttaaactggttattctagttagcaatttgtctaaccttttctcaaggttcttagcttccttgcattgggttagaacatgttcctttagctcaaaggagtttgttattacccacctcctgaagcctacttctgtcaattcatcaaactcattctctgtccagttttgttcccttgctgtcaaggagttgtgatcctttggaggagaagaggtgttctggtttttggaattttcagcctttttgcgctggtttctccccatctttgtggatttatccacctttggtctctgaagttggcgaccttcagatggggtctctgagtgtatgtcctttttgatactattcctttctgtttgttagttttccttctaacagtcagagccctctgctgcaggtctgctggaatttgctagaggtccactccagactgtgttcgcctgggtatcactggcagaggctgaagaacagcaaagattgctgcctgttccttcctctggaagcttcgtcccaaaggggcacccgccagatgccagccagatctctcctgtatgaggagtctgtcggcccctactggggaggtgtctcccagtcaggatacacaggggtcagggacccacttgaggaggcccactgtcccttatcagagctcaaactctgtgctgggagatctgctgctctcttcagagctgccaagcagggatgtttaagtctgctgaagctgtgcccacaactgccccttcccccaggtgctctgtcccagggaggtgggggttttatctataagaccctgactggggctactgcctttttttcaaagatgccctgcccagaggggagggaatctagaaaggcagtctggctacagtggccttgatgagctgcggtgggctcctcccagttcaaacttcccagtggctttgtttacaccatgagggtaaaaccacctactcaagcctcagcaatggtggacacccctccccgctccaagctacagtgtcccaggtagagttcagactgctgtgccggcatccagaatttcaagccagtggatctgagcttgctgggctctgtgggggtgggacccaccaagccagaccacttggctgcctggcctcagccccctttctaggggagtgaacagttatgtctcactggtgttccaggtgccactagggtatgaaaaaaaactcctttggctacctcggtgtctgcccaaacggcagcccagttttgtgctggaaacccagggccctggtggcatagggactggagggaatctcctggtctgtgggttgtgaagaccgtcggaaaagcacagtatctgggccagagtgcacggtacagttcctaatggcttcccttggctaggagagggagttctccaaaccctggtgttcctgggtgaggtgacaccccaccctgcttcagctcgccctccttgggctgtacacactgtccaaccagttccaatgagatgaactgggtacctcagttggaaatgcaggaatcacacgccttctgtgccgatcttgttgggagctacagaccagagctgttcctattcggccatcttgccagctgcccatcttttgtttttgtttgagacagaattttgctcttgtcgccaaggctggagtgcaatggcgtgatctcggctcactgcaacctctgcctcctgggttcaagcaattctcctgcctcagcctgccaagtagctgggattacaggcatgcgccaccatgcctggctaatttttgtatttttagtagagacagggttttgccacgttggccaggctagtcttgaactcctgacctcaggtgatctgcctgcctcggcctcccaaagtgctgggattacaggtgtaagccacgacacccggtctttttttgtttgtttaagacggagtctcactctgtcacccaggctggagtgcagtggcgtgatctcagctcactgccacctccgcttcccaggttcaagtgattctcctgcctcagcctcctgagttgctgagattacaggcacccaccaccatgcccagttcatttatttatttattttagtagagatggggtttcaccatgttggcaggctggtcttgagctcctgatctcaagtgatctgcccaccttgacctcccaaagtgcaattctcagattctttaattattcctcataaaatttttcaagatttagcaatacagtttggctgtgtccccacccaaatctcaaattgaaactcccataattcccatgtgttgtgggagggacctggtgggaggtaactgaatcatgatggcgggtctttcctgagctgttgtggtgacagtgaataagtctcacgagatctgatggttttataaaggagagttcccctacacatgctctctctcttgtctgctgcaagacatgactttacttctcctttgccttctaccatgattgtgaggcctacccagccatgtggaactgtgattccattagacctctttttctttataaattacccagtctcgggtatgactttgttagcagtgtgagaacagactaatacacttaataaagtcaatatggtacaacagttaagtgagtgaggtcaggaaccaaactgtccagcttcaactcctggttgcactaatagtaatgtgaccttcaacaagttacttaattacacatagcctcaatttcttaatctgtaaaatagcaaaaataataattcctgcctcacagtattggtgatgattaaatgagttaataatacattcaattctcattattctcatagctatgttctataaactctccatgaatactgaacagaaccactgctcctagggtaaatgcagagttagactcctggatccattatattgtggattcattaacactgaattcatggccaatagtggcataactaatgcccaaatgaagtctaacacacatattttctccctaaagcacatcgctgccttttgacatttcagcactatgcttttgggccacttttgctattctgagcccatgaatgaccccaggttcatgaatgacatgggctgagcctatgcccatgcccatgaatgaccatgacagtgctacacatattgattttgaggttacaaatacattttagcaagtaggtaaattcgcaaatacggaatccacaatagtaaagattaactatatatgtaaattacttagaacaggtccttgcacaagtgcccaattaaatattagttgctaccttttacttataggaatctagtttgtcattaccctattgtttaaacagtgcagaatacagtgaaaacttcatctcctatgctactttgattttaaactttttattacaaaaaaaacttctttagctcctaagaagttattaatactggcccaggggcaataaaacaggcactatcatacactgttgggttaagtacaaactggcacttttctagaaaaaaacttagtaatatttctttcaagaatcttcatcaggaacatagatgaccaaatcttttagcaaaataattgcccttacaagattatatttcaaggcaataataaaaaatgaagaataaaatgtggcagaaaaatgttcaaaaaggtgaaggattacaaacaactggttatactaggggatttgttagataaatcatagcacattcaggcactggaatcttatgtagatattaaaaaattgaaaacaacatgggaaatatgtatggtaagaacactaaatttaaaaagataaaaatttgtatgtatgattttgtttccactatcttgggaaaaagaaaaggaaaaggtatgcaagaaaattaaccaaagtcttcatcagcagtgaccaccactatagggatttggaattattttctttcctgtttcctaacactctcctcctatacactccaatttttctaaaactaacctacatcacttagcaagcagtaaaacaagaaaaaaaaaagcctcttgtgatttttcttcaggttttcttttttactgagcaaaaaggagagaaaaaggaggtatgaacaggtgactgagaaccctgtatgaaaggacaataataaggtagttagctgttggtatttttaaaacagaaatacgtgaaaattcttgaatattcagcaaaagaaagagtattaaaaagaatgtaagaatgagaggaaggaaaaaaagattaaatgcctttcagtaaagcaaaacactgaagaacaaagacaatagtttaaatttggagtagtgaaagttgttgctccatgtcagtgaaaagattacagtgtgtatgtaaatctaagacaatgagtattattaagaaagagatcacgagaaaattatacacatagtaattaaatcatttccttataagtgattaccagctatgaaaggaaagggcatttttattcttatagcaaaatataataaaatacagctgtttcaacatctgaagatcaattaatgtaatccatcacatcaataagctaaagaagaaaaatcacatgatcatatctatacatgccaaaaaaaaaaaagcatttgacaaaatccagcacccatttctgattttaaaaaatctcagaaaacctaaattagagaggaacttccacaatttcataaagaacatctccaaaaaacctacagctaacatatttaatggaaacttgaagctttccggccaacatcaggaacaagacaaagatgtccttctcaacattacttttcaacatcatattggaagttctagctaatgcaataagacaaggaaagaaaacacaaggtatacagactgggaaggaagaaatataactgtctttgtttgcagatgacatgattgtctatgtagaaaattcaaaagaaacaccaaaacccctctcaaaaaaagtgatgatagcaaagttgcaggatagaaggttaataaacaaaagtcaattgctttcctatatataaacaaggaacaagtagaatttgaaattaaaaacacattatcactttcattagcaccccccaacatgtaatacataggttacaaatctaaaaaaatatgcacgggtatgaggaaaactaaaaaattctgatgaaatacatcaaagatatatttcaggtctaacatgaagtattggaagattgaatatcgtcaagatgtcagttcttcccaagctgatctacagattcaacacaatcccaatcaaaatcccagcatgttagtctttagatatggacaaacttattataaagcttatatggaaagacaaaagaaccggaatagccaactcagtattgaagaacaaagctggatgactgaaaatacctgatttcaagacttaatcagtagaacagaacagagagcacagaaatagactgacataaaaatcctttgtcaaccaatcactgacaaaggagcaaaggcaattcaaagaaacaaatatagtcttttcaagagatgtggaacaactgggcatccacatgcaaaaaaatgaatctagacacagaccttatatccttcacaaaaattaactcaaatggatcacagatctaaagataaaacattaaactataaaactcctagaagataacataggagaaaacccaaatgaacttgggtatggtgataacttttcagttataacaccagagacacaatccatgaaagaaacaattgatatgctggacttcattacaacaaaaaagttccactctgcaaaacaaaatattaagggaatgagaagatgagccacaaagaaaaagaaaatatctgccaaagacatacctgataaaggactgttaaataaaatatacaaagaacttttaaaactcaacaatataaaaatgaattttaaaatgggcaaaaggcctgaacagacaactcatcaagaaagatatacagatggcatgaagcatatgaaaaaatgttgaatatgtcattagggaattgtaattaaaatgagataccactacacactgattaaattggccaaaatccgaaacactgacaacactaaatgctggagaggatgtggggcaacaggaattcttaatcactgctggcaggaacgcataatggtatagccactttggaagacagcttggtgacttcttacaaaatcaaacatactcttaagacatgatccagcaatcatcctcttggcatctgtttaaatacttaaaaaatttatgtccacaaaaaaacctacacacaaatgtttgtagaagctttattcataattgccataacttaaaagcaaccaagatgtccttcagtagaataatggataaagtgtagtacatccattctggctgggcatggtggctcatgcttgtaatcccagcactttgggaggccagtgcaggaggactgcttgaacccaggagttcaagaccagcctgggcaacatagcaagactccattctacaaaaaatttaaaaaatcagccacacatggtggcaagcacctgtagtcccagctgttcaggaggctgaggtgggagggtcacttaagccccagaggtcaaggctgcaagtgagccatgatcatgccattgcactccagcctggggatagaacaagaacctgtctcaaaaaaaaaaattaccaaaaaaaaaaaaaaaaagtatgctacataaatacaatgggatattagtgttaagaagaaataaggtatgaaactatgaagatatacggaggcaccttaaatgcatattagtaagtgagaaaagccagtgtgaaaggccacatactatatgattccaagtatatgatattctagaaaagctaaaactatgaaggcagtaaagcaaccagtggttgccaagagttgggagggaggttggagggaggtggagcacaggggattttgaaggcagtcacattattttgtatgatattacagtggtggatacctataattatacattcgtcaaaagccatggagtgtacaataccaagagtaaactctaatgtaaactatggactttgggtgataatggatcgatgtttgatcataacaaacgttatcactcaaatgaggatgtcaatacagaggttgtgcatgtgtgaggaaggggtacataggaactctctgtactttccactccattttgctgtgaaccccaaatcgctctaaaaataaagtttactaattaaacaatatatatactagaaagatcaataattctggagaataaaagcctcccacaaaatttgtctcactattcataaaaaatatgcatatgtgtaagtctgtaaccttcctttctcaaaaaatagatgcttcatatatcaggcttctgtatataatttataatgtgtatataaacgttaatttatatttacctcaatcatttatctctgctcaagtacatattaatcagttaccattattaattcaatggaagaaaagaaataatatgatgaacaggatcacaaagagttataaatcagagatgaaggtgaagagaaagcatgctaagacaacaaagagaaaagtaggctttgaagtgatgaagaaaagggcgaaaaatgcactggggttctgcataaagtgtgattcaatttagatttatatcctgatttatttaaaggaagtgggtgataaaatgttataattatgttggcagaatgttatcacatgttcctttaaatagtatattcagtctaaacccacaaacaagacacaaaaatcaggctgaactggaaagctacatgctttcagagtaatcaagggccaaatttgcacctcagaaaattattgtacccaagaggcaaaaaacatcatatgtgaacaatggagaaaacatccacaaagtgtaggtactaagctatgtatgacaaacgacaaaattacacacatggatgaattcatggatcatcacagtccaacctgtttgcattggcttgtttagacaccgccttcaatcttttcaaagtttttctaatatcatcagcatcaggaaaatggtgatgacctgcagccccataaggaaatcctggacgaactccaggcagaattcctctgtagataaatatgcacagtgactttcattactatctcagaagcaaagcataagcaacttctgcagaacatagccatacctttctggaagacctcgaccatatatttctcttttccatttagcttcattatcttctgctctttgttgctgcatttggtcaaaaatggcatggtaatgttcatactgtcctcgagaagaaaaagatgatggagctatagtccctccactgcccagaaaaggagcctagggattaaacaaagagctctcacatgtttatcttataaggcctaacaggcctgtactagtctcaaaagaaaaagtaaatttcaatgcttcacttttaaaaagtaattacttaatatgaacatactaacaaacataaagcctaaagcaaaatgttttcctattataactattaacaaccaaaaagcagtatactttgtaattgataataaagcataatgtgacaaacaaaaacagcaaaatgacactaatttcatgtaaatatggaaaaatttgatcttaattaacaggttttgaaacaagcttccaatatacatttcatgtaattctgttccgttgtttatgtatagcttatgagagcctccttttatataacactcagaattatatttaacaaaaacatctgcatatggcttttaatataccccaaatctttaaattcaccaagcagatatgaaggtataaacattattaaaacatgttctatatgtatataaaagaggcaaaaagtcatatctatctttagtttccaagtaagttgggaaaaatagcacaaaactagaaaaacattcaattctatggtaaacaagtgacaacagagaaattccaaagtagtaagtgctgagcaaatccacaaaacagtaaaaaaaaaaaaaaaaatcaacagtaaaatccttatttagaaaaaaggccttggggagagatattgtttaatctggtcttgatagcaatgtaaggagagtaaatatgagccaaggcattaaagtaaaaataatcaatgtatgtatatatttaggtatggaaggtggaagaggaaggaagtatgatgacaaatacaaggaaggcaaagtattaagtattaagtttggctataaaagcttggtatagctaaatgctaaatgctatctgcccttggtgtttgcgttcaaataataaataacaatagaaaggatttataaagtttctagcagcagtagtatatcaacagagttttaaaggtcagtaagtcaatattatgcatggtaagcagaaataagaaagtaaggcagaggaattaattagaaggatgttgctgccctgacaccaagccaagaagcctggaaagccaagaaaggcaatcaatgaaaaagtaactgctgaaggaagtttggattctctgcaggaatgacaaaggataaaggcaaagacttaaagactcaaccaccgagacataagaactcaaccacatggaaaactcatagtaaaaaatagagatgtcagaaaaggataagggtaaaagtaaataaaaactgtataatgctacagaagtcatggtgaaagaatttcattaagaagaaatcaataacctcaaatgcaaaggtcaacttattttaacttttcttatctgagaataagaccaccagatatgactaaggctgagtggaagcctttaaaaaaaccattttctgagtgtgtgaagtgatgagaacagaagccacaataatgagagtaaaaaagggaaaacttccaggtgataacatcttaaggaaaatgcctggttaaaaaaagaaacaaaggccaggcatggtggcacatgcctgtaatcccagcactttgggaggctgaggtgggcagattgcttgagctcaggagttcgagactagcctgggcaaattggcgaaacaacatccctgcaaatacaaaaaattagccgggcgcagtggcatgtgtctgtagtcccagctactcaggaggctgagatgggaagattgcttgaactcaggaggtcaaggctacagtgagtcatgatcccaccactgcaatctagcttgggtgacagagtgagatcctgtctcaaaaaataagtaaataaataaaataataataaaagaaacaaagaaaaatgtcagaatccaataaaagaaacttcagtgtaacccaataagacaaaatttgtcttccatcaaggtggtccttacatacatcctcaaaatgtacatctgaagtcaagaatcagaattcagttataaggtggtcatatttcctatgaaactggttactctttgaatttagcccaatgctaatatcatcttaacttgactgagtgctccatttctctttagcaaaaacaaaagtaggtaaacatctcagaagatgctcatactcaaaataatgttgaaaatactatatgagaatactgatgaaatatgtttgtttgagacataatttatgtacaataaaaattcaccaattgtaagcacaggctgaattctgacaaatgtagacactcacataaccactactacaatcaaaagcatatccattaccccagaaagttcccttgtgttcctttgcagtaaatgctcgcactgtcagcaaccactgatctgctttccgtcactacaggttggatttgcctttcccattatgtcatgtaaataaaatcataaatatgtactcttttatctggtttctttcactcacaggtttttaagattgatccatggtgttgcatgtataaacaggctattctttttactgccaaatggtattccaatatattttcaaacaagagatacacctcttccatattataatcaccatataaccatacatgtggaatatataatttttctaaaaacacattcataaaagacacattaaaaatggataaaacaaagaaggtccagattttgcagatactaaataatcaaaaacatttacattggatatttatactatgaataaaaatgcctcttatttagaagtacgtaataatagtattaattttgaaatactttagttttagttttatctttcttttggggaatctccttaatttgattcatatgatactgagcctccaggtccttatcaactatgtagaaatcaaacagcctaacaagttaaaatatttcaaattcaatgaggaataaatatagaaactaacatagaatttcctttaaatcatggaaaataaattgttttattaatcttcaatgaaagcattacagaagtttataaagtgatgcagaaatctattcagtacacagtatgtaacttgaaaattgtctcagttattaaacattaataaaactgattaatactgtattagacatcataggaaaaagcactttattacacaaaagggagaagaataaatcatcaaaacttcagtgctaatcacggacttgataaaaaaatgcttgagatctgaaggagtacaagttgataagctttctctttccaatcaggtaagatgtgaggttagttattttagaatggaccagattctaagtcattcctgatcattcaggaggtaataagttctacttaaaggtaagataaaattatactactaaaaacactgtataatctatattaatacaaatttggaaaaagttactcttaatgaattattactatgatatgaagaacttctgcacctcaagagactgaaaaacaaatctataaatccagggcagaatgtatatgtctagataaaacaaacttttattcaaattataacttttggagaaaaaaaaccaagaattataattgatccaatttgacaagtatctattgtacatctaaatatcaagattaatgggtgtacatgagtgaaacttatagtttgaagatgtattgacttaggctgggcacggtgactcacgcctgtaatcccagcactttgggaggccgaggcaggcaggtcacctgaggtcgggagttcgagaccagcctgaccaacatgcagaaaccccgtctctactaaaaatacaaaattagctgggcgtggtggtgcatgcctgtaatcccagctactccggaggctgaggcaggagaatcgcttgaacccgggaggcagaggttgcagtgagctgagatcgtgccattgcactccagcctgggtaacaagagcgaaactccatctcaaaaaaataaaaagatgtattgacttacagtttattcaatgatacaaattagtgcattcatcttctattgctgtataacaaactatcacaaatttagtagcttaaaacaatatctatttataatctcagttcccctggctcaggaatctgggtgcatttagctgggtcccctcctcaggatctcaccaggcagaaatcaaggtgtcagccagggttacaattctcacctgagactcaggatctcttccaagtttactggttcttggcagaattaatttccttgtggctgtatgactaggaccacaattttcttgctagttgctcattagagaccactacttgtagaggtcatctctactgttttgccacatgaatgtttactatcttccaggtgagcagaattctctctctctaatttcttttccccttccagtcagctatgaaggagtcttatatgttaacgtaaccctgggagagaccatcccatcaccacttgccatataacataacctaatcaagtgagctgctatactacagtatttacaggtaccacttatactcaagggaatggaataacacaaggtgtgtataccgcagttgagaatcttggagaccatcttagaattctaccaactacaaatagagatatgtataggatgctgtatgaataaaagaggaagtataagattcagactggcagaacaaagaaaggaaagggaaattactatagaagcccttgccagacaggttccaggcactgttcttggaaaaaaaacttttttttttttttaaatcaagaaaccaaagctcagaaaagttcagtaatgtgcccaaggttaaatagggtggatctacccagaaggaatgtttagattaactcatctatgtaactggttatttagctaaatggatggaggtgggacgtgagggtgaggagggatggagagtgctattaagtaaaaggaaacacaagtgcaaagacaaagagatttggcaaaccacatatagtaatgaaactacaaatatagtcttcatttcagcatgaatagagcatacagtatgtggtagggaatggatggtgatgaagttggagagacaacagggatcagattaagaagcatcttctgagaacttaatcttcaaggctacatgaaattacagaacgattttaggctgcagtgtcatgaattgtacataatttttaaaaattcctgacaggaataatgttatcatagtcttcacaaaaaacttttaaagcaattttgagtatagtcacataacagcaacacaagttacatatcagatacatgcaggaaagctaagtattcataataaatgttaaagaattctaggtaaaaattaattgtacactaaagaaagaaagaaaatcccaagtacatgcattttatagaacaaggtggaactggaggggaaaatggtagtataaccatattggtataaaatgcctacctttacttcaccacttccaccagcacttagcacatttctccatccttgttccctggccctatttattctttccaactttggggaaaagaaataaacaaaacaccatttcaagtatttaatataaaatacacgtaatacatttagcaataaactgaaaatcagtgtattccttaagaaaaaagtatatttaatagattatcctcttaccctttccttttcttgccttttcatttgttcagccttcattaaactaataatctgtaacaattttaaagacaagcttcttacaactcttgaacctattatcacttaacaacttgccaaaggtagaaaaacaagagcaaaaaactacctgatccttttgtttcttttctttttcaataaattccagccttctctttcttgctgcttccttaaataaaaaaaagaacattttaatccataataattcctgttttttctagtttcatcaggaaagttagtacaccaatggcagaggtatgttcaatgaggttttttttttaaaaaaaaaaagaagttataggtattcgtttgaaagaaataaggaaaggtttggaggctttatagtaagattttgtttcttttttaaaattatgtttgcaaagctttaaaataaccagacagatgtctttatacctcagatattttcctcctttcttctccagtattcactctcttctctggagtttgatgggcctggacaaaaagtaaaactacaaattaaataaagattttgaggcacttatttgaaaatcccaaatttacagaaatttaagataagaaaaaggtaaagtcaatacttccataactctcttccaaattacattatcttaaaaaaaaaaatcgtagtctttgatatgctgttaaacaaagagaaacattagattcaaagaaactgtggaaaagggtccttccccaatcatcaactaaacagttttgtgttcaggtatggatgtttaagttttccaatattatcatagactatcatttgaaaagcccaatgatggagataatttttttaaaaaaattagtgacacaatatatattcagtatataaaattcaaacaagattaaaaatttagggtctattttgctctccacctccagagtaacggtaaccactgttaatattttcattagtgtccttcagagattatttttgtacttatatatacagttcaactatatacatacaacaattttagctatgatttttacatacatgtaatattaatgtgttaataaaatgactttaatttttaaaatttcaatagctttaggggtacaagtggtttttggttacatggatgaaatgcataatggtatatattagatatttacatttcttcttttatatactgtttacctaactttggggttgttaatggactcatacaatatatattcttttgtatcttgcttttgctcaacactgttttcaaggttcattcatgttattatttatatctgcatctgttttcttcatggatatatagcattctattaattttgattcctttctttcacaattatcttatactttactcattaggtctattctaaagtatttgggggcgggactgatgtggtagctcacacctgtaatcctagcactttgggaggccaagataggaggactgcttgagcctaggagtttgagaccagcctggataacatagtgagtccccatctctacaaaaaatttttaaaaattagccaggcatgtggcccacacctgttgtcccagctactcaggaggctgaggtggaaggatctcttgagcccaggaggtagaggctaccatgagccatgatcacatcactatactccagcctgacagagcgagatcctgtctcaaaaaaaaaaataaaaataaaaaaatcaagtatctggggggtttgtgggtaattctttccatttattttctaatcatttattttttacatgttgcccttccatcaggccactttatttaatttattaatagtttaatgctgcttcaccacgattttctaggtaggtaatcatatcaaatgtaaatacgatatgtctatgttttctctcctcttccaatatttacatttctttccttttaattgctctagctagaacctctggcataatttaacgatggcaatgacagcaaatccctctgtcttgttcctgactttaatgataatgcttccaatgtttcatcattatgtacaaagcctgccataggtttcaggtgtgtatacatactgtattagaacttaccttctgtttcttgaatcaaacttttaaaaacaaaagttagtgttaagtttcaccgaattttcagcatctactgagatgatttttatatggttttcttctctaatctgctaatgcagtaaaattacagtaactggttttctactgttgaaacgtccctgtattgctgtaataaatcctatttgataattattacattattttttgataaaatgcctgattttcccctttttaagtccttttcttttttccaggatttctgcatatgttcttacaagtgatctacagttttgttttaccctgtgttaactacacaattttgtaatcaaggttaagcctaatgtatgatcaatttttcaaacaattctaactacaattctatataccaaaaaagataaaaatttatagaaaagtttaagttattctatcatgtaccagtgtttacatttttcagccaccttaaaaaaagatttaaaaagcatactgtacaatttttcacctacactggatttcaatacaaaggaaagcagacattacttaaaaaaattacttgggaaaaatattttgatggtcatttacattattagtaaaataatccagcatttgattatatcattaaaagttgtctctactaacaattccattttaacagcagctatattttaacataagtcattgatataaaattagttttatatattatcctgtgcttcagttttctaaattatgtagaatgaccataacagataggcactaaaattctaaccctgaaaagcaaattcaaaatattacaaaataaacatgaccctcacatcatttttgaaataaatgtgtcaccatatattaaaaaattagaaaggcatacaaaaatttactttcactgaaaacaattcaagaggataacatttctgctttagaaagcaatggtataatttaaactgcatatttctttctaatgaaacacaactattttacttcaatgaatatattattgagtatgagaccaggaaaatgctgatatctaaaatatgtaataccacccaatgggttaataaacttataaatgataataatgagtcttttgtaatgtgctttggcattttaattaaatgatcataagccaattttattggtatgttttaactcaaggctatagcaacaaagtgataagcggtactaaatctcacacctgattccactcttatgactaactaaagaatgcatttactctctgacaaaataacccaagcagtgggttcttagaactatcccacaccctcactgtattattagttcctaactcctaacctctaattttggctagttatttcaattcaactcttacttaagctaaccatttacgttaccactttacctcagaaaagacattagagttgatgagataaaaacaatactgaaatatttaaagaacattagctttcaaactttttctaaaggcgacccacaataagaaatatatttcccatctggactcaggaagatacatacacacccctaagtttcataaaatatcttcactatatgtatagcagaccctgctactttctatcacttgaaacaaacaaacaaaaaattccctgctctttgcccactacaatgtttttgccaccactaatggatagcaaccccttgttttaaaataattatgagagatctctgggggcactattgttgaagaacaagaaataaaaattgtagataatgctcctcatagtatcattacaaaaacacagttaacatttcaaggtatgttctatgtatacagaatttaaacagtggggaacattacccagaagctttgtaaaaatacatattccttctatacaaacgaatatttggcaacaaaaagaaaatgaagtactgatacatgctacaacatagatcaactgtgaaaacattatgctgagttaaagcagccagtcacaaaagaccacatactatatgattccatttatataaaatgttcagattaagcaaatctgtatagaaacagaaagtagattagaggctgcctagggctgcggggttgggggaagaatggggagtggctgctaatggaaaaaggatttcccttggggtgataaaaatgttctaaaattgactgtgcagatcgttatgcaactctataaatacataaaaccatttaattgaaaacttttaatggctgaattacgtacagtatgtgaattatatctcaataaagctattttttagaaatacatatcccaagagttactaaatcataatctttggacatagagccctacattccatattttgacatgctgcacaggttaactttagtagccagtctagcaccattctcaaaatttgtgaactacaacaccaaacaattaagcaatttaaaaacattaatacagcaacttaatataaataactggattatatatatattacacaatagtgtggaataagaagagaatgtttacatattcatatactcttgggtaagttacataaaggccaagattgtattcatcttctaatggttcatattgccttacatataagatattcaaatatttatgaaatgaaaatactaagctgttcctctaagatcacacaggtattttcagaacactatttctatagtgaagagaataatacgaaacacaaaacatccacactgagagaactgtttgtgttctttttaaaaatcacagccaaagtactgaagtataacataatatattcaaggagctccctctggtggcttaatggccactcctttgctttaacagagcctttaaaaaaaaacctatgacttacaggaactggagcaaaaaaaagtctcacaatacatgaatattttgtggacaggttgaataataacaacttaatgcacattagcttaaatttgtgcaattaaaacatgacagtatcttaagtggttaaagctttcctttttcaggcttgaagttaaaaattctaacgggccattgtgaatttcaacctaaaagatgctttaatttccagggggaaaagaagtcttttaaaaaaatgagataaaaaaaaatcaagggaaaggccgtgtgtggtggctcatgcctgtaatcccagcactttgggaggccgaggtgggtggatcacttgagcccaggagtttgacaatagcttgaacaacatggcaagaccccgtctctacaaaaaatagctgggtgtggtagtatgcacatgtagtcccagctacttgggaggcagaggtgattgcttgagcctgggaggtggaggttgtagtgagccaagattgcaccactgcactatggcttgagtgtagtgaaggtcctgtctcaaaaaaaaagaaaaaaaaaatcaagggaaaaacctatatttacaatcatgcaaaaatcatatttaaaatacttcagaaatctggggtttattttcttttaattcttttgttagaagatttgaaaaactttccacacaatcgactgccgtttcttttttttcctacttactttttcttttcttcaaatgtttttttcattgtggtaaaatacataaaacaaaatttatcattttaaccatttttaagtgtgcagttctgtggcattaaatactttcacattgttgttcacagaaacttagttttaagtgaaaaaaaaaatttttttttttttgagacacagtctcgctctgtcacctgggctggagtgtaatggcaccatctctgctcactgcaacctccacctcccaggttcaagtgattcttctgcctcagtctcaaaagtagccagattacaagcacatgtcaccatgcctggttaatttttgtatttttactagagacggggttttaccatgttggttaggcaggtctcctgacctcaagtgatccacctgcctcggcctcccaaagtgctgggattacaggcatgaggcactgcacctagccagtgaaatgtttttaaaataagctatataatacttcaagggctgattattatttagttctcaatggtctagctcagaccatacttgtctgcctgatgaagtttgagggcaacgactctgcctgaaattcaaaacatttataactaccatctgaatcatttgcctatgattcagaatatttgatagtagagatattattcagaatattattaactgaaatctgaaaattccaaagcatgctgcttttatatactgaatattaatggaaaataaggaaaacattaagaaaaccaacacattacttgattctgtcagccatatgaagaaacagattatacacttggctacaatcctacccaaacactagggactttctatgatatcatttatccagattcaccaacagttctgatctctccattcagtcaggctgatacatggccaagagataaggcaactcgcttctacaagtccactcgagcgtgtattccttacagacataatgacgtaaagatacaaacactcccaacttcccatctctctctacccccacaatggtagttttattccatgggaagacagagaattccatgtgtatatattccaaacattaaaatggattacatttgtaaaccatttagaataaataagcatcttaaaaatggtccatgaaataaatttactttgaattcatatttcactgaactctattagaaaacataaaacatatttccaaagaaattttgatccacggcacatttttttaaaaaaggacatttataagaatccaacccacctgactgatttcataccaatgaaatacaactactgataatcacaagtaaaaatatacaaaaagtatatataacactaagtaaaaacactagaacacaaaattatctataaactttctgagctatattaaaaatacgggcaatatatatttgaatataaataggaaggcccgctggacgtggtggctcacgcttgtaatcctagcactttgggaggccgggtggatcacttgaggtcaggagttcgaggccagcctggccaacatggtgaaaccccatctctactaaaaatacaaaaaaattagccgggcatggtggcacatgcctgtaatcccagctactcgggaggctgaggcaggagaattgcctgaacctgggaggcagaggttgcagtgagccgagatcacgccattgcactccagcctgggggacaagagcaaaactccatttcaaaaaaaaaaaaaagaaaacccaaaaaacaaataggaaggtccacaacaaaatttagtaaaattaaatgcgtgtgtaaatactggggatatgttttacgcttttattatataaaactcttaaaagcacactaaaagttatagcaagtttattaaaatacatacttcacagaaaaaaattacagatcaaagttatactactcaaattacttcaaagaaccaaataactttaataaagtctctatttcaagaattagatatgtaggtacagaatcaatttcaaatgttctagagcttccttttcattacctcaacctgaagtagtttttttacattagattttatttttaaaaatggatacataataattgtacatatttatgggatagatgtgatattctgacacatgcatacaatgtgtaatgatcaaataagagtaactgggatatcgtcagcagctgcttttaaacattaagaataaaagctctctccctctccctctccctctctccctccctccctctctccctccctccctctctccctctctccctctccccatggtctccctctccctctctttccacagtctccctctgatgccgagccgaagctggactgtactgctgccatctaggctcactgcaacctccctgcctgattctcctgcctcagcctgccgagtgcctgcgattgcaggcgcgcgccaccacgcctgactggttttcgtatttttttggtggagacggggtttcgctgtgttggccgggctggtctccagctcctaactgcgagtgatccgccagcctcggcctcccgaggtgccgggattgcagacggagtctcgttcactcagtgctcaatggtgcccaggctggagtgcagtgtcgtgatctcggctcgctacaacctccacctcccagccgcctgccttggccttccaaagtgccgagattgtagcctctgcccagccgccaccccgtctgggaagtgaggagcgtctctgcctggccgcccatcgtctgggacgtgaggagcccctctgcctggctgcccagtctggaaagtgaggagcggctctgcccggccgccatcccatctaggaagtgaggagcgcctcttcccggccgccatcccatctaggaagtgaggagcgtctctgcctggccgcccatcgtctgagatgtggggagcgcctctgccccgccgccccgtctgggatgtgaggagcgcctctgcccggctgcgaccccgtctgggaggtgaggagcgtctctgcctggccgccccgtctgagaagtgaggagaccctctgcctggcaaccgccccatctgagaagtgaggagcccctccgcccagcagccaccccgtctgggaagtgaggagcgtctccgcccggcagccaccccgtccgggagggaggtgggggtcagcccccgccaggccagctgcccagtccgagagggaggttggggggtcagccccccaccaggccagccgcccagtctgggagggaggtggggggatcagccccccgcccggccagccgccccgtccggaagggaggtgggggggtcagccccccgcccggccagcatacccgtccgggagggaggtgggggggtcagccccccgcccggccagccgccccgtccaggaggtgaggggtgcctctgcccggccgcccctgctaggaagtgaggagcccctctgcccggccaccaccccatctgggaggtgtgcccagcggctcattgagaaccagctatgatgacagtggcggttttgtggaatagaaaggggggaaaggtggggaaaagattgagaaatcggatggttgccgtgtctgtgtagaaagaagtagacatgggagacttttcattttgttctgtactaagaacaaattcttctgccttgggatcctgttgatctgtgaccttacccccaacccagtgctctctgaaacatgtgctgtgtccactcagggttaaatggattaagggcggtgcaagatgtgctttgttaaacagatgcttgaaggcagcatgctcattaagagtcatcaccactccctaatctcaagtacccagggacacaaacactgcggaaggctgcagggtcctctgcctaggaaaaccagagacctttgttcacttgtttatctgctgaccttccctccactattgtcctatgaccctgccaaatccccctctgcgagaaacacccaagaatgatcaataaaaaaataaataaataaataaataaataaataaataaataaataaaaagaataaaagcttagcctggttgcggtggctcatacctgtaatcccagaactttgggaggccaaggtaggtggattacttgaggccaggaactatttgccaggaactagtgaacaacaacaaaaatccctaccctcatgaatttctgcactgtagtggaggaaactggtaataaactaattgaaaatagattagaaagtgataacattgtggagaaaaacaaagcagagtaaagtagagtagaaacgtgggaatggcgtagagggatggttattacttgatatagtgtgatcaagaaaggctctattcataaagcaagttttgagcacagacctcaaagaaaagacagcagcaagtacaaacttgtttttgcaggtaagtacttggcatgtttaaggacaacaggtttggcaaggctgtaccgggactagcaagggaagagtagcaaatgagacttggaaaggtaatgaggctgtcgggggctttgtagacagttgtaaagactctggcttgcttttttttcttgaaaccaagtctcactctgtctccaggctggagggcagtggcatgatctcagctcactgtaacctctgcctctcaggttcaagcaattctcctacctcagcctcctgagtagctgggattataggcacacaccaccatgcccagctaattttttttttttttttgtatttttagtagagaaggtgtttcaccatgttggccatgatggtctcaatctcttgacatcgtgagatcaaggtcacaaggcccacctcccaaagtgctgggattacaggcaggagccaccgggcccggccgaccctggcttttactgagtgggatgaaaagacactgaaaagtttcaagcaggagagtgtaacgatctgacttccatcataaaaggaacatttgggctgctcacatgagaacagactaagagggtaagtctgaaagcagttagactaatcatgagattattataaccctggtggaaagtgagggtggctaggactaatatggtggtaaaaataatgagaagtagtcagaccgtgaatatattttgaagtcacaattgacaggatatgacgtagaaagagtagtcaataatgactccaatatggaagatgagaacaaatggaagggcagagttcccatttactgaaataagtaagatcaatttggagagagaatgaaatcaagagttcatttttatatatggtaattttgagatgtctattagaaacacagctggagatgttaagacaggtatcagtctccagttcaggaaaggagtccaaggtggagatacaaatttgagagtcagcttatagatgttatccattagaaagttcgtatggatacaaaaaagaagatatctgaggcctgagaccttgagcacctcagcatttaaaagccctggaggtgaggaggaacttgcaaaggaggctgagaagcagcagtcaatgaggtaggaagaaaaccagaagaatgtaataccagggactcaaatgaagaaaatatttcaagaaggagggggcaatcaagtgagtcaaaaactgaggtcaaggaagaagaaaaatgacccatggatttaataatatagacatcaggagccatttcacaacagctgtttcataacagctgtgacaaagaaagccatgagtgaagtgggttcaaaatgaaatgaactggagacagtatagacaatcttttgggaaagttttgttgttaaagggaccagaaatatagagaggtagttggaaggacataagggaaagttcctttttaaaaagacttaagatataggatatttgtttgctaacatgaatgattcagtagagagaaaaaactataatgatgcaggagagagcgcaaagtcctttagcaggcaaaaaagaatcacagtatgcaaatgattgagttgatcctaactgggaacagaaacaggtcatccaaagtaaaacgaagaaaggtaaaatatttgccaacaggtaagactgactagcagaagtaattgtgggaaagttttcttccaattgcttctattttctcagtgaagtaggaagaaaatattggtccttgtgaaaagcaaagagaaggtaaaaaataatcacctaggaagtagaagagtaaatacactgaggaaatataatagggtgaccagaaggtgctaatttgatattgttggttacatattgaaagttagactagttacaatagtcatatgctttctccagccatattccactgaccagcttcaggcacaaatgaagtggagagttggatttcacaaagttaagttttttggttattggtaataatggaagagagggcaagagagctgaccatttggaaattattataaatgaatatggaatttaagccaggtaaggaaaatagaaacaaagagggggaataaaggaagttattaggattcatggatccaaatgggacagatgttttggaggcagactcctaaagaagtaagctagaaacacaggaagtggtgatcagggaacgggatgattataaatgaggctaagaaagagttgttattattgataataaaaattttaatggcatggccataggtgagagtttcaagttaaagtgggagacaagatatttgaaagagaatgatcaagaaaataagccaggcacggtggctcatgcctgtaatcccagcactttttgggcagccaaggcaagagcattgcttgagcccaggagtttgagacaagcctgggtaacatagtgcaaccccaccactacaaaaaataaaaaattagctgggtgtagtggcacttgcctgtggttcagctactcaggaagttgaggaggtggattgcttgagctcaggaagttaaggcagcagtgagccatgaccgcactactgtcctctagcctgggcaacagagcaagactctttctcaaaaagaaaagaaaagagaaagaaagaaaatgaaaacaaaaggccatgttctataggaagtatcatctttttttatactaaaactgtaaagaattatgacaatattggaaggagtgacagtgagtcaggtgttaaactcttcaaaagacaagggttggcggggcgtggtggctcatgcccgtaatcccagcgctttgggaggccaaggcgggcggatcatggggtcaggagatcgagaccatcctggctaacatggtgaaaccccgtctctaataaaaatacaaaaacaaaattagctgggtgtggtggcgggcgcctgtagtcccacagtcccagctactcaggaggctgaggcgggagaatggcgtgaacccgcgaggcggagcttgcaatgagctgagattgtgccactgcactccagcctgggcgacagagggagactccacctcaaaagaaaaaaaaaaaaaaaaaagacaagtgtctacagatgatcctaacacagaagagcagtaggtgatacagtctggtagcaaaagcatcaaggtagagagatgaggagaatggcaggatcaggcagcagggagagtctggcaatgagaagcaagggaaacatttccttcatcctacctctagacccaataatattaagggattagagaaaacagccagcatgtaagacagctgcagaacagtgtgttcagggacaaaccaggttttcaagcaaaaaaggtgaagacatctttagaagtttaaaatacagtggattttgccaagaatgtactataagagagttttctggaagagattacaggttggtgcaaaagtaatggcggttttgctttcaatgacaaaaaccccaactacttttgcaccaacctatagaaaactatgcaggggtgggggcagatcagagtatgaccagagtcttacagcaataggagagtctaggcagtgagggaaagctggagtcctaggcttcctgtggtgactgaagtaaagagagataaaacgataagatggaattggcccacttaggtttgaatacatctttttaaagatagataaaaccagcaggccagttaccatattgcccctcagctccaaatctactcttcattgtccagcttgtgatgctagagctggacgttgtaaacatttcttctttgattgctaacacaatattaagctttgtcagtaaaactgagagggtcactgcaaaggcagaagcttctcttcctgattagtgtgtttcctttcttcctgttactgcagcaagtgggacaaacagcagcactcacccctacaggcaccttccaggagtgtttggccagtgcccctaccagcttccctgtgagtttcagcagcacctgcaagaagagcttcccacagaattctgctggtgcctcagccagcatcccagctagagcagcaccagataagttccactggcaccccagcaggcttcccagtgagttcaacggctcctcaagtggcttcccagtacattctactgacactccaggcagtttcgcagggagtttcgtcagctccacagtggacactttcctctttgccagccccagactgtggggccatcgagtgagctactgccataccctacccagtaaggtctgaatctcagccttcgcgatggggttagggtttctttaaaaatttgtgtcttctttgggtactctgcctcagcactaggaatagcagctgcttcctgtatctgctattactgcatgctttaaaaaaaaaatttttttacaatctctcattttattattataatttttctaaatttcttttttgtttttttttttgaaacagaatctcatggtcacccaggctgtagtgcagtggcgcactctttggctcactgcaacctccgcctccccggttcaagtgattctcccacttcagactcctgagtagctgggactataggtgtgcgccaccacacctggctaatttttgtatttttagtagagaaagggtttcaccatgttggccaggctggtctggaactcctgaccccaagtgacccacccgccttgacctcccaaagtgctgggattacaggcgtgaaccaccacacctgacctatgatagattttaaacaaagtgactgatcattcctactatataaagtttatcttacagcagtgtgtatacatacatatctaaggctgtgtatatgtatatgtatgtgtatgtaatccaaaatgaaacaagctccatataccaaagcatgcagctactgacataaagaaaatgtcaaattcctgcaactatcactgtgttcttgggcatgtcgcttaaattctacaggtcttcatttttcatctgaaatatgacagagtagattatatgatcacattccttccagctctatgattctgtttatctgattgtgaattctcaaataccaaatatttccagatttttatcaagaatgtcataggtatttatttcatttatgcacaaaaacaaatggctctgcttaggttgctcaaaagttatttcatttataatgtcactcgctttttattacactaattatattacttaatatatttacttaatgactttttatgactcctgtaaggcttctcagttttagaggactggtaaaacacagaaggaggacattccttggtaacttaataaaagtaatcctataatatcaaggtaactgaattgagctgcaatgaaataaggttgaattgaatttgttattaacacatggtatgtaacatgatcatacctgtttatgtttttgcagtggtttcttttcgtgtaattttttatctccatatttcttatatgctaaaggtattccatatttagcggcaggctttgtaattttctgagcaggcataacagaaatcgagttttgtcctgaagctggtcttttagctagatgaaaagatacaaagaattttgtctgcagttctttacattaactctttactttcagaattcttcaagatagcactgtttaattttcataatcattgatagtattttaaactttctatcaaatatcttaattcatcccttagtatttactaatgccttaactattttaccctaaagtcactttttgacagaagctaaaagccaaattcctctaacatgttgaagtttttaatattaaaaaaaaaaatccctgaaattgactgtgagtgatggttgcacgtatcggtgaatatactaaaaataatttaatcatgaatatactaaaaaaaatttaattgtagacaccaaatgtataaactgtatggtatgtaagttatgtatcaatagagctgttaaaaataaaggccaagcgcggtggctcacgcctgtaatcccagcactttgggaggccgaggcgggtggatcacgaggtcaggagatctagaccatggtgaaaccctgtctctactaaaaatacaaaaaattagctgggctggtggtgggcgcctgtagtcccagctacttgggaggctgaggcaggagaatggcgtgaacccaggaggtggagcttgcagtgagccgagattgcgccactgcactccagcctgggcgacagaatgagactccgtctcaaaaataataataataataataataatagtttttaaaaaattcacattttagaaactactttcaaaatcagaagataatcaagagccactgttaagcattaattacatcaatataagcaacttttttccttcatataatgtctgaatggtatctatacctacagacctgacaaaaaagaaatatcttaaaacaatcattatcattaagggttccacagaatgggtaccttaaagactgctggcagaaatataaattggttacactttctggagagcaatctatattaagaatattatttatgaattgattattaaagaaataatcagagaaactccatgcacaagaataaaccctgcagtattatgtatttaacccttaatgaagcctagatgaggttcagtcttagaagggataagttcaagaaaaacaccctaaggtaataaaaaggaaattctactatttattcacatctctggaggatattaaaagaagtcagagtagagtctacataaacccttattgaaaccctctttccctctcttatttttaatatctgccaagatacccctctgctcaaactcccctaaagcctaagcagcagcttgctttcttccacttgcagactgctctctagctcaggattttatattgtgctaaatcaatttaaatcaatctcttccagaagtgttcttactttttaggaggggaaaggagaaaaaaatttaactggtagttcaaaatgaaatcctacgactaaactcagttcttcaaaaaaatgtaattgtaatagaaaatgttcatcatataatagtataaattaaaagaaacaaaacttctaataacgcattctcaatttgtagttatgcatatatcatcacagaaaaatatatcaaatataacagtgtgtgttaaaattggggtaatttttcttttaaaacatttttataataaatatctattttgcatataatttagtaaactgttttaaaaataaaaacaatataagccattaagtcggcattttagagattcagaagtaatttttgttgacaatatgggatatacgacgtgatagggtaaggttttccaaacacatactccaactgcatcttgacccagaaaccaggaagcatgagaaaaaaaagatttccctttgagagttcaacagtacaatcaaattagaacatacacatacacatatacacacacagtcacaatactgcaacctggctaaacgtgttaatagaatcaaagaaatacagcgcatgccagaaaaggggctagaggcgcaaaagcataaaaaataaagatttctaagaaacaaatatgaacagtcccatctactttccagagaaaagaaagaattacttatctgattttagagtatttttcaggatcattgacaaggctacctatggcatgaagtttaacataggggactggaggcgacaaagtatttatcagtaatactactcctattaagcatttcattcaaccaaatgctcttacgacaaattactttctaattcctatatgggtttatccatgtggaaagaacgtgctgacactgggtatttccagcttttgtgacaaagagccttttgattaagatatgacttctacgaagcttgactgcccactgcccagagaaatcatgctgattcttggtctcttgtaaattctaagtgagttgacttctcagggattggtggtctctgcaatgagaggatgtgtaagggtctttaagaagggctaaatgcagctggtggctcatgcctgtaatcccagcactttcggaggccaaggcaggcagatcacgaggtcaggagattgagaccatcctggccaacagggtgaaaccctgtctctactaaaatacaaaaaattagctgggcgtggtggtgggcacctgtattcccagctacttgggaggccgaggcaggtgaatcccttgaacccgggaggcagaggttgcagtgagctgagattgcaccactacactccagcccggcgacagagcaagactccatctcaaaaaaaaaaaaaaagacgggctaaatgcagcttgccttcctgagaacgcactgtcataccacttctagctaaatgggctcatttttatgatacatatttttattaatttgtccaaattcaaaatggagtagtacaaataattacgtttgaaaaacaatatacccttcacgtattaaataacttccattgattttagaaatccattctgaaatcattctattcaggaaaaaaataatttccctctcacatagatacatctaaatacatatacatagtatataaccatattcacaatcttacaatgattctaataccactggtcacattgtttaaaagaaaacctatctttaatgaagtgcttgactttacattcacttaatttaaaaaattcagaatatgaaatatttctcaaagaaaatattttacaactgggtgcggtggctcacgcctgtaatctcagctctttgggaggccgaggcgggtggatcacctgaggttgggagtttgagaccagtctggccaacatggtgaaaccccatctctactaaaaatacaaaaaattagctgggcttggtggtggatgccggtaatcccagctactcggaggctgaggcaagagaatcacttgaacctgggaagcggaggttgcagtgagccgagattgtgccactgcgctccagcctgggcaagagcgaaacttcatctcaaaaaaaaaaaaaaaaaaaaaagataatattttatataaagatttacacaaaaattggacattttacaattctataacaacgttctcaaaatatcagctaggcatttgataaagacataagatttcaagccagatttcatttaaataaaatgaacaataaatgagaatgttattaatttataagaaactgtatattgccataaaacattaataattctaaggtgcattttctctggattaaatttatcctagaattatcccaacttactacatctacatatatttccagtttaattagggttgattattgcaaacagatgaaaggcttcatatcagatttcatttacctggtataggctgtgatccaaacttcgaaaatgtttttagacaaaattcttctgcaataagctgagattgaaagagaaaaaaattagaaaagatgttacattttcaaaataaaaaacctacccattaattataatacatcttcccctttttcagtagtaattatgctgccaaataaactgtactaaaaccaagttgttaaaaaaaaaaaaaaaaaaaaaaaagaagcccaggtgtcgtggttcatgcctgaaatcccagcactttaggaggctgaggggaagatcgcttgagcaaggagttagagttcagccctggcaacacagtgagatctcgtctctattttaaaaattaagaaaaataaaaaaaaatccattcaataaattcctctcatgcttactccctcccaatcttatttatgtatgtatctgtgggtgtatgtttttgagacagggtctcactttgttgctcaggctggagtacagtgagacaacaatggctcactgcagccttgacctcctaggctcaagcaatcctcccatctcagcctcctattagttgggaccacaggcgtgtgtcaccatgccaggctgatttaaaaaaaattttttttggtttattttttatggagatgggggtctccttatgttgctcaggctggtctcgaatgtatgggatcaagtgattctccttcctcagtgttccaaagtcctgggattaaaggtatgtgccaccgtgcccagcactaatttatttttattagttctccagatagaggctttcttctcaaattaatgtaatgaacaaggtaggcatccatacattactcgcctatttcatctctcagcaatttaacacaactacctatctggaaaaatctctatattctgtgtgcatccatagccttcactttcttcaaaactactgaagaatctcttcattatcaaaagaaattatctagtaatctctcagttattttaatttactctgaatcctcttaacatctccaatgagttttgtagctcataattataaattataactaattttattaagttattgaatatgtaaatattcttaattcaacaaatgtacccatttaatattagtataaacgctccattatatattctccagcatttataaacatagatgtttataaatcaggaacaaaaatcatttacattttctgcaagtaattttttctccttactccatatttttctctccttcacttcaaaactatgataccaacaaagaattaactcgatttatgcttttttttcttactttgtggggaaggcaaaggcaagtgaattttctcttttttcaagagaactgattcttggtgagagaatcttcctatattaacagtggtccagacactccaataggcaaaaaaaaatacatgatctgagggggttgtttttcccattaagaaaatccctagagcaattctcaaagtctcataccagcaggatcagcattacctggaacttagtaaacatgcaaactgtcaggctccacttcaaaattactgaaaccgagactgttgtggtgagactcagcaatgccctctaggtgattctgatgcatgctaaagtttgagaaccttttcactagtggacaaatgttaagagccaagtctggctcacaggcaatttagagcaaccatgtgaacgtgtgttctcttctcaacaaatgcatttttttccttttctttttcttggaagaaaacaggtggtttatgatctccatcttgtccccaaatctaatcatttcttccactgttggagaagtctttgttttcctgtgttaatgctcatgtgaattgagagatggggcatatagaatccaagaagatcctgaaaaccctacgttatgttttccaatagagtagccactagccacatgcgcctatttgaattaaaatttaaggtatatatatatgaagcttttcagttataccaaggacatttcaagtgcttactaaccacatgtggctagtggctgcaatattgaacaatgcagatatagaacattttcatcatcacagagcattccactggacagcccctacattcctaatgaatcagaacttacccatggtttttcaagccatatccaggaagaagttgccacagtgcccaagactgaaaactaggccctatcaaccacggttgatggccttgagaggactgaggtattaaaatggtagggagcactacagtgatactggaaataatagtttatatgttacactaaagctcatgaattgtttcaaagttatagcctttaaaaaaaggtatcacaactactcaggaggctgaggagggaggactgcttgagctccagaggtggaggttgcagtgagctgagactgcaccactgcactctagcctgggtgacagagtgagactccatctcaaaaaaaaaaaaaaaagtatcacaaagcttctcacctaagtagatatatagtacaaaataaatctgaggaacagcagataaaggtttttatctttaaacaacaagcgatatatagtagaaaataaatctgagaaacagcagataaaggttttcatgaagaatgaaatctaagtggtgcttaaatagtaacaagtagggtctatgtatataataaacacataatgtcaaatatcccatttgtgaataatcacaatctacccttgtttcttttcatattataagtttggcacattttaggcttgaatattttctctttcattgctagctagctaaattccagtacttcagccttgagacagtatgtcccaactcctggtatagggagaaagaaacctcagcaagactaaatgaagtcattgtttattctctagtggctgccaaaaaaacaatagtatgctacataataaaagtgtcctcgcaaacgttatttataacaaaggagtcttgtaagacacccacatttcagaagctgctgctatgacctatacaagtaacctttaatctccaaattttatttggctttcttgcatactaatgcattctcctggtagtaacagtaaaatcaacatctgttttctgaagagtatttggtcacatgcatgttctgttaagtcagaaggatatatgatacttccttcttctccatgagcatataaaactaatataaaaaaactatagttttgctgaatatcttatttactgaagaggttaacagttatttaacaaagacctcactaaaccagaaaagtaaaacaattccaatctcaggtgatcaaatttttatgaataacttatgctaattgatttgatatagattgcttcaaaaatcttgtgaaattaaaattcagttaaactcaacaaatattatgcacctacatgtgtgcactaaaggagaaatcatgagtcagtaatctagtatacctacatataaatggtttctagtcatttcctatcaaaaagaatataactataatatataaattacgttaataacacatttataggccaggcgtggtggctcatgcctgtaatcctagcactttgggaggccaaggtggacagatcacttgagctcaggagttcaagaccagcctgggcaatatggtgagtctctgcctctacaaaaaatacaaaaattaactgggcatggtgacatgtggctgtagtcccagctacttgggagactaagatggaaggatggcttgagcccaggagatggcagttgcagtgagctatgatcatgatactgcattccagcctgggcaacagaactacaacctgtctcaaaaataatttaaaaaaaatttgtattagtaaaatacattgatatgtaggtgatatttaagacattaaatattttgagcacttacatgctagacattaagcactttatgtgtattatcacttttaattctcacaataaccttatagatacatttaataatccctttgctcacaggtgaggagagtgaagcacagaaatgctcaatgattttacagttagaaatccagagaacagaggaataacgcataactggaaagcaaacattaagaaaacagttatataagaatggaaaggctgggcgaactggttcacacctataatcccagcactttggaaggccaaggtgggatgatcacctgaggccaggagttccagacaagcctgaataacataatgagactgtctctaaaaaaaatttttttttaatattagctgagtgtggtggtgcacacctgtagtctcagctactcaggaggctgaggcagaaggactgcttgagcccaggagtttgaggctgcagtgagctatgattttgccattgtactccagcctgcacaacagagcaatactctgtctgaagaaaaagaaagaccatggaaaggaaagtgacactaatgtagtttgaaaaaggcacaccattcctccaagatccagatgtgttctcctcaacactggaggccatgtcttagctaagcaacataaccctactgtttaattttaaaggaaaaagaacttacctgaggagagagaaacttttcaatgcgtttggctataaaacctttctccaatatggagttgactgatggtctatccctaggatttcttttaaataactgagacaccaaactgcggagatcataggaataatgcaaagacacaggtggaaaagatccagatattatcttcagtaccaggtttttcatactgccagcttcaaactaaattccagaaaataaataacatataggaaacatatataaattgaaactgagaatatcggtaatgagaaatagttcttttcctaccaatatagaatagaaacacaatcctcttccaaataattagaatatgttttctagagcaaagtttacttggttatctgtaaattaatatcagccctcaaaaaataagagtaatttttacttattcgaaatatttaaagatgggatgtattaaataaacgtttcataaactataacaataatcaaatggtgaaaggttatgcctcagaggtagcaaaattagggccaaagaaccacaagcagaaaaagaacaacctgctggtcttcatttaagacctgacttttagtgcctctgttgtaatgactagaacaagaaattaactacagaactaaaagtattgggggaaaatataataaataaaactactaatactttccttttagacaatgctcactattatgtgtgcgtgtgatgctcctaaaagctatggaaatcagcaatataaaaaatatcttaataggaatatatatgtcagaattaaacacaatataaactttaaagtaaaaagaaaacaagaggtagggcagtttaaaatctgaagatttcattttgaaagagggcaatattaagcttttgatatctccactaaaatattacagaacaattgtacaatgttgatatcttcttaatatacatattaataaaataaaatgtactataaattaggcatcagtgattacaaaagttctactaaatgttgagctctcctaaatgtcatttgagtaaattcaatcttacagaaacatctgtacacctaaataggaatcctaaatgcagaaaagatgtggttctctattccaatgcactttcgtttatctctcaattgacacgctcttcataaagggtaagttactgaatttcatgtatcttaagacacatgctacttaagagtaaacaatcccaaaataaagaagagatggtgacagaacaatgtagttgcaaagattttttaaaaacccacaaaccaatggtttaaagctcaaataactgtgttgcagaaaaactgatcaattatttcaaataagcatctgataaccaccatcccacattactttgtcagcttatgcttttttccttaagaaagaaaaaaaaaactaaggcaatatagtaaaagggtatgcaaccattaaaaagaatgacaagaaaaaatattccccaaatagtattaagcaataaagtcaggttataaaacttcttataaagtctaatcaaacttttggggaagaaaaaaaaatttcattttacaggtagtcaatactggctggaagaactgcttatgaaccttattcacttatttatattttctgaagttttgtgtaatgaaaatacaatattgtttaatcagtgggtaaaaaatgttaatcactttccatttcaaaaaactgcttttttaagattaaacctacttaggacaagaaccctccccctttttagtgtgttatatgttatttcaaaaaaaagtctcaaaagtaaaaattttaaatactctgaattaatgattactcaaattgataaaagtcatcagtgagtatatggaatgaaattctttaaattagttcaattccaaactcaatctgggtgttttgaaagaattcactaaaacaaaactagtaaaatttattaagctgaaatatcaaattcatacaaaatttaacattaagaaaatagcaaaatttatttctgtcattagaaataattttctggaaaatatgaaatattataaaatagcaaatataccagatatgcatatatacaaagggaaatcgatttatacttcagaaaaaatgagaaattcaaaaatggacttagaggagaatttctaggatgagggttacctgaaagataatataacttaaaatataataaaaacattatagtcgctttttaacataactttgaaagtatttcagaaacttctacttacagcatgtttaagtgtacacagctcataaaggacacaccccagagcccaaatgtcactggagaagataaaaatgagaaatttcctctaagtatttcaaattttttcatttaaaggaaacacaaacagcataaaagtgttttggaaaaatatgtgctccagaaaaaatttcctttaaaactaaaaatttcaaccataatcaaatgacaaaagtagctgtcccagattggaaaaagaaaatggttgccccaacaattactttgaagcttcattaaagaaatttaatatttaaaagaacaatatcaaaaaaattcacgtaaattctatttttatttcataaaactcaaacttttttcaattatttgtaaaataccatgattttaaaaattataaaacaaaatactaatttaatggacattaaaaatgtattaagaaatttgcaacagctactgactaatgttaccttggttgggattttccaattagagagagaaaataaagggtagctggaatttaatggtagaattgctctttctacgcacatattatatagtctgctagccagactacagtgctgtgattagaaatatgggcttgggagccagatgtctagtttggatgctgattccaccacttattagactcaaggatttcaaagaagttaccttgcctctctctgcttttggtttccttataagaagaggaggaatgattaatacctacatctcccaaaattattgtgaagactaagagaatacctagaactcgaaacagtacctggcttatagtgtgttcaagaaatactagcaataatttaataagaagtgactatcatgaagaaaagaccaaagaaagcactctactttcaattataacataaataataaggtgattctttctgctgttcttccagtaagataatcaaatagcttttttacaattcccctcaccatatattagcaacattttatatatacatatgtgtttacatgtatgtattatttattttagaatagtattccaaaggttaataaacatgacaacaaaaaaattgaaagcaaatacatcacataatgaatatcattttaaataccttttattattgtaaggtttgttttcacagatttcaggtgacaagtagtatggggtccctatgcaagttcgagccagctctacagtactagaagaaaaataaaattattggagaagttaaagacacagtcatgtgccacattaatgttgtttttggtctacagcagatcgcatatatgatgctggtcccataagattataatgacactgaaaaattcctatcacctagtgacacggtgactgacatacactgtagagcaattactttattttttaataaatttagtatagccgaagtgtacagtgtttataaactctacagtagcatacagaaatgtgctaggtcttcacattcactcaccactcactcactcacagaaagcaacttccagtccagcaagctccattcatggtaagtgtcccataaaggtatatcatgttttatcttttatattgtatcttttctatgtttaaacaaatatataccattgtgttacaatttcttacagtattcagtacagaacatgctgtaccggtttgtagcccagaaacaataggctacaccatacagcctgcctgtgtagcacactctatcatctaggtttgtataagtacactctataatattcacccactgacaaaatcacctaatgatgcctttctcagaacatgtcccaataaagcaacatcccagtaaagaatgtacttaaagataccataaattatcacatatacatcatcatggattgaaggttcgctgaaaacattatatcaaaacaaagtttaaaattcatgttacctattaagaactctagcaattccaaaatctccaagttgtactgttccatctttagttaaaaatatgttctgtaaaagacaggaaaaaaaaaaaccctagaaatattgttacagtccagttctaagtcaacatttttcataaaatttaaaatccagttaaaaaaattgtgctagagtaactggatattcacatacaaaagaataaatgaagtcccctacctcaaatcataaacaaaaattaattcaaaatggagtctagatctaaatatcaaaactaaaatacaaaactcctagagaaaaacataggaataaatcttcatgccattgggctagggaatggtttcttagatatgacgtcaaaagcacaagcaaaaaaattaaaaggataaattggactatcaaaattaaaaacttttgtgcatcaaaggacaccatcaagaaaagagacaatccataaaatgagagaaaatttttacaaatcatatatttgagaaaaaacttttatcaagaaaagggcttgcataactcaacaataacaacaaaaaaaaccaaatagtatgacttagaagtaggcaaaaggggccaggcgcagtggctcacacctgtaatcccagcactttggaaggctaaggcaggcagatcacttgaggtcaggagttcaagatcagcctggccaacatggtgaaaccccatctctactaaaactaaaaaaaattgccaggcatggtggcaggtgcctgcaatcccagctactcgttggtctgaggcaggagaatcgcttgaacctgggaggcggaggttgtggtgagcctgaaatcacgccactgcactccagcctgggcaaaagagcgagactccgtctcaaaaacaatagatagacagacagacagacagacagacagacaggcaaaaggcacatacttcataatacccatttatataaaatgtccagaataggccaatccacacagacagaaagattaagggttaccagagtctaggtggagaggaatgggaactcactgctaatgggtacgaggttctttttggagttataaaaaatgttctgtaagtttcagagactgggaaggaaagtaatttttagagtatgggaagcaagcaggagatctaatacaggatgcagatgaataggataaaaaggaagagacaagacagataatctgatgcacactaaatcaggttcaaaaatttttggcccaaaacaatgaaggttccatgtctttatccattcagaagttatcagtgacagaataacatacctgagatttaatgtctcgatgaagaatttttctatcatgtacatgtttcagggccaaacatatctgtacaaaccagtccaaaatctaggaagaaaaatcagatctgtcaagcctctctttgaccattaaaagaattcaagaatatttagggatgagaggaactaaatccttaaaaagatattttaggctacaatttcttttaactttgtaggcactgacattaaatagatattcaagtcaacacaagctctgcacatactaaatccaaaatgtaagagatgttactgggtcatctcttataaatcaaaacaaacatggaaagtaactttatgagtgaaaatgcaaataatttatattttataatattaagacaaacaggtgattcttctttgtttttaatacatcttttttctataacgccccccccccacttctttagggatagggtcttgctctatcacccaggctggagtgcagtcgtgttatcatagttcacttcagcctcaaactcctgggtttaaatgatcctccagcctcagcctccgagggactaggactataggtgcatgccaccacgagcagctagttttttatttttgttttttttacagagacagtgtcccactatgttgcccaggctagtggtcttgaactcctggtctcaggagttcctgagattcaagtgttcctcctgccttggcctcccaaagtactgggattacaggtacaagccactgcatctgacctctataatgctttttaaaaatataaaaatcacaaaaggaaaaaaatcaagctggaaatttggaagacatctctgactttttttctcttcccacatttattatatataaacactcttctctggagacggccacttggaaataaaaaggcttaatttctatctcattgttaacatcaaaacaattccaagtacatggcatttttaaactaaaaaaaaataataaaagaaaacataggttaattatctgtaataattgactaaagcaggactttcaaaacatgacataaaatgcttaagtcatacgaaaaagactgataaagttgactacatacaatttaaaacaactgtagagcaaaatacatataatcaagtttaataataatttgagaaaatacctgcaacataaatgatagattgctagttctctaagatgcaaaagttattcaaatcactgagaaaagtactggcagacaaaataagaagtggacaaaagactggagatgcaaatgacggggcgaaaaaatgcccgaaaaacgcatatacaaagtactaaactccctcacaaattaaaaaaaaaaaattaagatactatattatcttgcttaaaatgaaataatacatactgtatgtcagaatgttgggaaaagaagcctttttgtcacaggtgtttgtgaaaaggttaattataatcatttgtcaaaatatgtgaaaattttaaattcacataccatttgaaacagcaatttcaatttcaaatttatcctacaaataatatcagaaatataaaaccatgtatataagatatttactacagcactgttagccagaacccaaaaatataaacaacctgaatgttcatcaaggggcctgattaaatatattgtatgatccctatactagaaatactatgcagtcactgacaagaatgaagcacttctatgtatactgtttatgtactattaagtgaaaaaaggaagttccaaaacagtatgcatagtatacccctatttaaaaaaatatgcttatattccatacctgaatctatgtaattgtgtgtgtgcactgaggaaggaaagaaggaataaaggaaggaagcatagaaggatagctaccaatcagttaacagtgtttacctcagggaagtggattggcagaagagggaatgaaaggtaacatgtttaccttttactctatctcttcagtatttttttaaaaaacaattttctttaaaaaaaaaaaaaactctcagttcagttctatagatatttatttaatgaggattacatagattgttaagttcctttctatactcacgtaaggcattttaagtataaagatcaaaaacagttctctaaggagtccgtacagtgataaggaatatactcacaaatacctataataattgcataagctttttaacagagatatatacaataagacagcaattaattcaacaagggagaggtcaggaaaaagaaagtgaaaattatgttaagttgagtattactgataaaatggagtttaccagtagaaatggaacacatcttagaaaccactcatgtctcatttcacagacagtgttcttctattaccatatttcccatacttgtacttcttaatttgacaaaaatttattcagtaccaacaatgtaccagatatgtgcaggaactagcaaaaaaaaaaaaaaattaatgaaagagctcagagatcaggggtcagcaaatttattctataaatggccagacagtaaatattttaggttttgcaggccagatggtttctgtctcaactcaagtcttccattatagcataaaagcaaccacagattataagcaaacaattaagtttagctgtgttctaataaaactaacagagatagggggccaaatttggttcatgggccattgtttattgatccatatcaaagactactgggggagatgggtaagtaaaccagtaattaaagggagtaatgccctgagttgaaaaagcatacagaaggagcggcaacacagtctggaggtgataaaataaagctggacagaagaggtgatttctgagctcagttttgatggaatatgtaagcaaagcagagaagaaaggcacagcttataaaatataaatgttacattttcattccctttgtctaccctagttcagactcttgctacattagggtttgaccacatggggttggacttggaggagagggaagccctttaaaattgtaaccctggtcaggcgccgtggctcacgcctgtaatcccagcactttgggaggcctaggcgggcagatcacgaggtcaggagatcgagaccatcctggctaacacggtgaaaccccgtctttactaaaaatacaaaaaaattagccaggcgtgatggcgggcgcctgtagtcctagctacgcgggaggctgaggcaggagaatggcgtgaacccgggagacggagcttgcagtgagccgagatcgcaccactgcactcctgtctgggcgacagagtgagactccgtctcaaaaaaaaaaaaaaaaaattgtaaccctgcttctaatctgtgcattttatttcatcacacattagttccatattaatatttacaaaatactgtttcgaaaatgggattctcttgctcagaagacttttaaattcaaatgttatgttgtattatatcaagaaccatacagtaattatcatatagttgtctgaattacagttgtatgttattttgcattagtacagacggccttatagcaccaaacagtaccacaattcatcttctctgctccaaaactgagatttctatgtgtaataaaatgtattagaattttcccaaagtatgctcagttttgatgggtttatgcattaattttttaaaggcatgagcttttattgccaaacattatactaatggaaaaacttgaacttggcttctctattagaatggtaaactgatcttggaacttctaaccagaagaaagtaagcttaccatttactgtctgtgtaatttgctcaaagagtagatatttcatgtctaccagaataattttctctgctttatactgattttatcatttggttatgttttttgaacaaaagttcctcactgtgaagatccttataattttatttccttcatctacattttacaatattttgtcactttgattaaataagtaaccaaagaatgttacctatttgttagaaaaaaaattttcaggatacttctcactaaaactattagctcaacactgctatacaacatgcctgggaagacttgccaaatctaaaaagatgctcagtctttcctaggttaagtctgtatagctaaaatactattaatatttcacaaaatgcatgctttagagaaggccctggagatttgtcagtaactttgctctccatttttatcctcaagaaaaacattcatcaagcccttatcaaatctatgtactctgccccaacagagcattttattctattattggttactataataaactaaccacagcctttcagtctcattatcaaataggcctttgctgcttgatgcttgccagaaagctcctgaaaaggactacactaggaatgccaaactactggcacttcagaaaatagactcttgggtacaagtttctgacctaacattgcttaaatgatcaaggaacttatcaatgaactgagtcagaatttcttcaagacttttttgtacataagctgacaaacatcatgaatgctaactgcttgatccaagatcaagaattactaggaatgaataaactgaattaaataaaatttaattgtggttgtttggaatatgattggtattatttttaatgttcaaaatttaatgaatagatgaggaagccttttttctttcttaagctatatctaattctcaatttagattatgtttttataaacttaaaatgatatttgatcttaataatttactcagaattcagaagcaaatagttttacatatttttacttttcaggacaatattggtaattttcatgggttcgataagaatctatattcctttttatcagaatgtaattggacaaatcaattgtgcaaccaaggccatacctggagtgccttatttgagatgattttcatgtaatcagttatgacaaacctactactaagaaatatatgtggaaccaggctgggcgcagtggctcatgcccataatcccagcactttgggaggcagaggcgggcggatcacgaggtcaggagatcaagaccatcctggctaacacagtgaaaccccatctctactaaaaatccaaaaaaattagccggcgtggtggcgggcgcctgtagtccctgctactcaggaggctgaggcagaagaatggcgtgaacccgggaggcagagcttgcagtgagccgagatcacgcaacagcactccagcctgggggacagagccagactccacctcaaaaaaaaaaaaaaaaaaaaaaggaaatatatgtggaaccaatacttacatagtgctgccaggaaactgtcctgttatctaacttacagggtccctgcgtcgtaaatggtaaagtcactttctagcaaccagggaccttggcatatttggagattctcaaaaagaaaaaacttcactccaatttataggtactacaggtgaaatttggtagagaatgtatcgggctcagtttcctgacgttaggatagaagaacaaataataagagtttttaaaaatccaatcaaagattctttatgaaaatttatagacagaaatcaattctgtaaccttagtagttgtttgataatataatgctctaggttttcagagcaaactcaagttctttgtttaattaacattcttgctgcacctaactatttggaccaaccctaatgaagccagattttattttgatcaagaatatattctgaaaattatttatggtcacatgtggggagactatcaaaaaaactcatccaaaactttcaaataaggcaaaaatactggtacatctttaaaatatctatgtagagactgtccaagggaacgtacttagttcatctcattattttctattaataaagtcatagactcaggttgcttcttaacctgactagatttttgtccagtaaagatgcaaacaggaagtatcactgaagagaatggcttcagtagctggagaatcatctgtttcacaggtcttcctgttccccacttacattctagaaagggacaaaatcatctcaaactgatgctaagctacagtttaatggagctctaagttttcctgtttcaaagcccagaaagtagtttaaatgacctcttcctattttaaataggctaaaataaatagcatccttatttgtgctaacagaacttgctattcagaagggtagaaaaaatgctattaacttaaaagaatggcttgccaaatttttatcatttatgataaataacttcactgatggatgaactatacaaatctccataataatttccaggaagacaagatacacacacacatacacacacacaccacattatgtactaagagtacttatcaaagagtagaatcaaatctataaaatatcaatgtgctttataagggaatatcatttaatagcaaacattttaaagttcgatagggataaatgaatgaaaataagcacaaacaatgaaatatatctgacaatgttctaataaaaatagcattgtatatactaacatacattactatttgaccttcaccacatgtatagtaggtatctccctattaacaaatgagaaaataatctcagaacttgttaacagaacaattaccaacttgataagtagagcaagaactcaaacccatgtctgtgcctggccagaaatggcacagtggctcgtgcctataatcccagcactttgagaggccaaggtaggaagattgcttgaagccaggagtttgagaacagcctgggcaatatagcaagacctcatctctacaaaaaaaaaataataataaaataaatttttaaaaaattagctgggcctagtggcacgtttctgtagcagcagctactccagagagtgaggtgggaaaattgcttgtgttcaggagtgcaaggcagccatgagctgtgatggtgccactgcactccagctggggtgacagagcgagagcctatcttaaaaataataatatcccagccaggcgcggtggctcacgcctgtaatcccagcactttgggagactgaggcgggcagatcatgaggtcaggagatggagaccaccctggctaacacggtgaaaccccatctctcctaaaaatacaaaaaattagccaggcgtggtggcaggcgcctgtagtcccagctactcgggaggctgaggcaggagaatggcgtgaacccggaaggcggaggttgcagtgagtcgagattgtgccactccactcgagcctgggtgacagagtgagactccgtctcaaaaaaaataataaaaataaaaataaataaataataataatatcccatttctgaatgtgtgtgtcttaatgtatatatgtacatgtgttaagtatggaaaagaaagtctggaagaatacaccaaactaaaagcagtggtaatctcaggaacaaaagggtggagaaagaagactttccatttctgtatacttcaatacttttataattcaagtgtgtgaaaagaaaatgttataaactttagagttagaggtgggttcaaacactgactatgtgatttggggcaagtacttaacctctcttggattccttataaattgaaaaaacttatccaaattagaagagataacaaatacaacactcctagcacagtgctccctctactcccctatgtaaaagcgggcaattaaaattaagaactggtgataatgagaaatgtgataggaatgtagagaaggaaaatatcacagattaaagtagttatggaaaatttaaagaagctgggacttgaactgagcttaaaaaaaaaaggtagagtattaataacaaagtttggggaaaaggcttaccaaaataaatgaaataatcagagtaaatacacaggaaggagaatgagatgtacaaacatgtggcccggtgcctaacacaaagcacatgctcaataaatatctgttaaagcaaatgaaaagaggtacagattagggaatagaaaaaaataaggctgcttaggtagggaacggccatattttagagatcctggaaatcaaaagagagattagatttaatgcagttgtcggtgcaaggcttctagagctggagttacctggcaaagccacattttaggaatatatagtctggcagcagtaagccagattgacagaatatagactagtcagttataatgaataattaaggcatatacatagacgcatgatatatataacatacatcacagagataacaatatatcattacagactataaatgagatgggcaactgaacaaaggtggcagctaattagaggtaaatatgagtaaactattgatatactaaacttccctagtaattttgattagcatttgtagttaaaaacaaatacacacataaacaaattttgaactacttctcaataatagagtaagagtcaatttcctaaatgcaaacttacctgatcctcttgaaacaaaacgcctttctgagcatttattcgcttaaacagatcccctccctcacagtaatccattactatgtagagagagccattttctacaaaatataaacattacagtccacttttaaaaacgtacatcaaaagcatggctaaattaaaagtacttaaaagcttactaaaaagcagctgctgaacaaaaaacaggaccatactcaaaagaattagggcacaaagtcaaggtataccggtcacaaagattgtataatgacttaggttaacagaaaactccatcattaatgatttctattaaaaatacactattttattgaatagtgctgtttgcattgacctaaacatctctgaaatataaacaaaatgcagacatacttgatttcattcaataaatacaattccttaaatgtcacacataaaatcatgtttttccaccaatatatcacatcagagatgggttatcttagttttctgactggccattaattctctgctttgttttatccactttaatcacttacttattaaataaataaaataataagtgttgtgataaactctgaggattcaacagtgtataggatacactgtttccaccctctttgagctttccttaattttatgcactttttaaaaaattgcatatgatttgtgaacaaacatgaagatgggcactgccccatccacctttatgtctcggtccacaaagaaaggtacttctgtgcttcttcctatggatagaaaggactacaagaatacttcttttttttatttaggcttttttttttcttttaagaaaaagtgtctcaatattttgctcatgctgaccttgagctcctgggctcaagggaacctctcgcctcagcctccccaatagctaggactacaagcccatgctactgtgtccagcttagaagaacactttgatgattctttccatcccttacttcttaagtaaggaagagtggccaatatcacttttaacattttctgaatcactacatagtactgagactatcacaactcaaagaacagttttcctagttctcacttctttcactgactgtgctatggccttatttccagcagtattttttttttcttttgagacagggtccaggttagagtgcaatggcacgatgatggctcactgtagcctcgacctcccgagctcaagcaaacctcccaccttagcttccagagtaggtggaaccgcaggcacacaccaccacacctggctaattttttaaatttttgtagagatggggtctacaaacaccctatgtttcccaggctgatctcaaattcctgggctcaagagatcctcccacctcagcctcccgaagttgctgaaattacaattgtgagccaccgcatccagcctccaggagtatttatttcttatactttgtggtgacattcttgtcactcgtggtgcacatatcttcttttgatctactgtttgtaatgtgccactgggataagaatctatatgataaagctaattaagaatctgtatgactttttatgattgacctggaaagatcatccaaatatacatgtgagaaattataatgtgaaaaaaactcctgaaaactataattcactatttatatgtatatagatgttataatgtatgtagcataacaaaaagcaaaaaattacatatactatgctatcatttatgtttgatgctagcatgtattcttctaaaactaagagaaataataaagccttatttttaaaatacgctaccccttttgaatcacacagatgtttctatgtgaagcagtcaatataaatccaaaacatctgctggaatatttgctcaaaaccttttaacttgaaatattaaaattttgttaacaacaacaaaaaaagaaactaaaggatagatgccaggagaaagataaaggaaaattcaaggtcctgaaaaggaagagttggttaattttgtactctttcacatgaaatataaatcttcatttcactgccagcataaaaaatacagtaccttgtgacataatgtattaattgaatcacatttttataaaagtagaagagacttatagtagacacagagttcatctgggaatgtagtaactttagctctaattcagactctgaaactggtatgtgatatgtccctgagtcatttcaattatcttctactttcaatctagattacctggtttttagtttacagaaattaagttacagaaatttataataatgagaatatttgggtaggacttcaataaaccactttgacctgcctttagagaagctttgccttatcttaatacctgcattattaaatataatgcatatagttccaaaacagcattatagctataatactttaagaacctgagaaaactttcaacatacctcactattataatagtgaggtacagaggagcatactgagtgaggatactttctaaagatcagaacattttctcagtggtagtggtggcagcacttacaggaagttcagttaaaaaatatgtaaattactgttcttgctctgtccaaattcttgcacttactgcattgcttcttttaaagcaatcactaataacagccagtattaaattatacaggcacagttgggaggctgaggcataagaatcacttgaacctgggaggcagaggttggagtaagccgagatcatgcccctgcactccagcctgggccactgagcgagactgtctcaatttaaaaaaaaaaaaaaatgcaggcatgatatcagtattgtccttgaatcaagctgatattcatatgcgtatgtttttaagcaaaaatggtatctttttcctaagaatgcattcacaaaaagatttattaatgtcttaggattttttaactctctcgcataatttatctgaccttcaaatgattctctatactggacaatatttggatgcttcatgtttgccaatactgcaacttctctccttgattcttctctttctttactggacatcttaaatgggaggaaaaagaaaatagtaaatgaaaccattaataaacaacctaaaagtccatcaataggtgagtggttaaaacataatagtattaatacagttcaatcaacaaaatatagcaagaagttaaaaagaatgagttgaatctgtaagtagaaacattttaagatgtccaaactagattaggttacagaacagcaagtatatttttctaaacacataaacataagcacatatcatagaaaaaatctgaaagaatatataggctattctgatattagcgggaataaaggagtcttttgctttaggttatcgattacttttttttttttttaaagaaaatctctaacaatgagctctattgtaactaaaccattactcatgaaaccaaactaaaaatatacttactcttgagatgttaatttccttgataacatactgtctgccatcttctgtagatttaacaagaatggcttttccaaatgaaccttctccaatcttctgtagtctaacatacttctccatgattctttttctaaggcatctttacagatatgctagacatttaaaaaactaacaaaaaagataaagcatttataacatgagataaaacattataacttcataacaattttaatgtttaattcaaattctaattctttagtgatttgctaacattttaaaaaaggatatttaatatattcactaaaagttacactttatatactttactagtacaacctaattacatccaaaaaagagaaaaaaatgtgatatttcaattttataagaatgctttggaaagccaaatactgcatatacttaatgtatggagagaaaggcaaacttacatgaattaattagtagcattactttattttctccaaaaagaatgaaaacctaataatacactatttcttgaagttatttaactaatcccctcttattcaacattcgtttaaaatgtttgctagtatagaacaattttggatagtttttgtacacatattttaatgtgcttattgtaaggatttccttaggataaattctgaattcaaagaatatgcccatgttacagtatggctttcaaacatattaagtgtcttaacagaactgtctactaatacgtatttagccagtagtgcctgctactaggtaccctcattaacactggttattattatttcttgtatttagggagatgtttactgtaatgtcatttataacaacaaaacactggttgttatttattaaaatctttgagaagcaataaagggtagtagttaaagaacactaaaaagtttaaatcttagctttatcacttatttgttatgtaaacttaggcaagttacttatctctatgtgctcagtttggtcacatgtaaaatgtgaataaccatagtacatatttacagaagtgttggaagaattagttaatgtaagaatgtactgaaaacagtacttggcacatatgaacactgtgtcactatttgttattgttgttactccatacgtctaatggggaaaatggtgtttcgtttttattttgatttcttttgcttaccagtgaatttgaaaaattcttccacatttattgaacatttttttttttttttttttaagacagtctcactctgaagcccaggatggagtgcagtcacacgatctcggctcactgcaatctccaccttccaggttccagcgattcccctgcctcagcctcccaagtagctaggattacaggtgtgtgccaccacacacagctaatttttgtatttttagtagagacggggtttcgccatgttggctggtcttgaactcctgacctcaggtgatctgcccgccttggcctcccaaagtgctgagattagaggtgtgagccaccatgagcggccacatttattgaacatttctattttttctcttttgaactattcatccatgttctttaatcattttatactgagttggtctttaatttgtaaaaactccttatgtaatgaagtccttatctgtcataaattattttcccttatatcctagttgcctttaagtataaaagattattttgatataaacaaatgtattaatcttttctttatatttctacttttagtatcacacttaaacccttaccataccaaaacaattgattaaggtcattagtatctttaggaatagtaatttcaaaagagtggtagtttcaggagaagccagaatacaataagctagctagtgaaagctgaaaaaagtgtgagaaagagtcataagagcaataatgtgtacaacctattggcaatatcacccttattgtagacatacatgaatttactatgctaatctgaaactaataaacatttaattcacctagcttgctcttttttatttccattcatagcaggcttccaatgtgtgattcctttctaggagaaaataagtttgtcgtgaaactctttttaaatttctgtggcagtttaccatatttctcattgtaaattaaaaaatccatgttcttatctcatccatcagtgccaaatttgtttttaactttattttgcctctaaaaatgatccaatctccttaaatgacaaacatcatatgctgtgcctacaagaccagaccacaggccagaactcagcctgtggtagcactgatgagataagtatgactcatgaaattttgtgagaaagagcctttctctaccttagaaaacaagattgcctttagcaactttaagagaaacaagaaataaaccattattatagcattttagcatcagtgagttaaagaagaaaagttgttccaaatatattttcaagcccaagttgtgttaactggcacaatataatggctatctgggcaccagccacaatttaatgatttttccagaacatgaatgtttaatatattacattactatgctacttacaaaaaaaaatcaagataaactcatcttagtaatctaaatttcaaaaattaaattaaataatagccatataatgagattacttcacaatcatcattattctgcgactttctgccaagagagggaaacaaaattagtcaatttggccattccttaaaattaagttgccaattcctttctagggaccacactaataagacagaagctccaaaagtccccagtgttgcattctactgccaacaacattactgaacattgtggttctaactctataaagcagacctactgatcctgttagtaaagaaagatgactctaattgccatcaaatatgtcaaatgcagacacttttctgaacaacaaaagacttgtggtagatgactttcaggaaaacagacaaactctccttttttgtaatgtcagtgtacaataaaggaagtaaaagggaaaacatgaaaaaatagattactttcagcatcttacaatatatttaactgagctacttcctagttgtgagacttctcaactgaattataattccataaaatttttcataccaaatgaaatagaaaacaataacaaattgtactataggcttccacatacaaaatcataacttataactgaaggaacatacgaatcctgtttacttcagtattgtaataaactcaaattaatgtttgccttttctaccattcagtttccaacatcaaatgaaaatcacaataccaactttactcactctatagtgttcttaaggtctctaataattatatcaattcaatctctataatacatagctgatcctgaagataagcaacaaggaaaaaatcagagacttttttgatatttgagctttccaaagagttatgtcacctaataaagcaatgaattcagaatcaagagacaagactagctacataatcaaacgctaaccatctgccttttgtggacttcagtttctttatctagaaacacgaaagatttaaacctaatgccattttatagaccttgccaagtcgactagtctatgactcaaggagaagaaaattaaaaagtcagaaaatatataatgtcaacactgtttagaattgtactcttagccacaaagagtaagagtgatggggaaagccattccatcaaaaaattaaaagaagtcatactaatttctttagcctaattatttaaaaagtaaaaataaataaactgtaatctacagttaagcatactagattgacccgtacatatttacctctactacttgtccaaacctgaggaacatgactttaaagggattaccaaaaaggcaaaacagaagagaaggcaacagcaatacagttctagaagctggcaaacacaaaagaacatgcagcaactgacttaggagaatagagaaaagctgtaccttaagccagcagtgggaaataagtcagaaacaagtcaattcccaccacaaactagctcaataattggaagtactggggcatctaagagtgaggataatattaggactcaaacaggattggtgaagagcttgtgtaagaagtgtcagacacttagtttgcctcctccacctctcccagtcagataagtactcctctcccatcttgaaagaagaccacagatatctctagattgggtacaccaggcacaactaagaatggaaatcccatctatgatctaggagattaagtgaaagtctacataataaatcgtgagactctctttcaaccatgatggtgttcttagtatcagatcacctcaccttccaaaacaacttaaaacctgaacaaaatatataaagaaacagcaatgcattgaggggctataatcaccgaaaggtggaaacatactagtgggttctacattcatcccagccttttccctgaagagagtttccaaactgtgctacagtacaatggagctcaagtataaagcagcagtcttgctgaggagagaaagcggtcagagttcagggctaccaaaatcctgaagaggaaaaataatagaaggagtccaaaaatctacagtaagttctgctcctgttattctgttcctaaactgtgcatacatggaggaggactgaaacagtctcatcctaacaaagcctaaaagcaaccatggataaaatcaaagttattcactgatacttcatcagactgccaaaacaaaactaacaatttttacaagatacatgtttcagagtctctaagacttttcattcacaatgtctagtatcccatcaaaaaataatgatgcacattaaacaaaaacagatatagactcacaaatgactcaaacatgaagttactaatagaggacttgaaagtaaccatgattaattaatatgtctaagaaaacaagataaaaagatggataaaacagattttttaaaagatggagaatttcaacaaagaattaaaatttttttttaatttttaatttttttttgagacagagtctcgcactgttgcccaggctggagtgcagtggcgcagtcttggctcactgcaagctccacctcccaggttcacgccattcttctgcctcagcctcccaagtagctgggactacaggcgcctgccaccacgcccggctaatttttttgtatatttagtagagatggggtttcaccgtgttagccaggatggtctcgatctcctgaccttgtgatccgcccgcctcagcctcccaaagtgctgggatgacaggtgtgagccaccgcgcctggcctcaaaatttatttctaaaaagtggacattctaaaactacaatataaaatatctgaaattaagaactcattcatggatttacggcagacaggacacagcagaaggcaggattactagcctataaaatgaaccaatagaaaatattcaacaaaaaaactgagagaaaaatattaaaaaacaacaacacacaccgggatgggggtgggggtggagaaagaaatgtataggaagacttaatatcataaagattttcattcctaatctctacagttaatgctgtcctaataaaaacataagctttggggctgggggtgattagacaggctgattttaaagttcagacacacacacacatacacacacacacacacacacacaaagaagaagaagaacagccagagaaatattgaaaaagaagagcaatgaaggaaaatttgtttggcttaatatcaaaacacattacaaagctacaataattatgaaataggcaaatcacaggaagtccagaaatcaaaaaacttttaaaacttggttaataatcatagtgacatttcaaatcagtaggaaaaaagatgaattttgaaataaaaagttcaaagccagcagtgagacaactgggtagccatgtggggaaaaaaagttaatttattccctcattttacaccaacctaaattctagatgctaaaatactgaaatgtaagaaataaaagcataatagtaataaaataaaacatgggagaatgacttctgtcttagagtggttagctgaagcacaacacaaaatcaaaaaaccttgagggattaatatgactagaccaatattttagctattacaacgatctcatttttctaacaaataaaaaactcgtacatatttataagaccaaaaaacacaacaatccaaaagaaaagtggacaaaggatatgaagttaaacgttaacactgagaatgaatacaaattatgttaaaatgtgccacgatacccaatctcctgtaaaacgatatacaattttggccgggcatggtggctcacacttgtaatcccagcactttgggaggccgaggcaggcggatcacttgaggtcaggagtttgatgtcaggctgaccaacatggtaagaccactgtctctactaagaatacaaaaaattagctgggtgtggtggtgcaggcctgtaatcccagctactcgggaggctgagacaggagaatcgcttgaacctgggaggcagaggttgcagtgagctgagatcacaccactccactccagcctgggtgacagagcgagactccttctcaaaaaaaaaaaaaaaaaagaagaagaaatacaattttaaaatacaaggggtaagttttatgttatgtatatttaaccacaatttttttaaaaaagcacaagagacggcatgtttcatcaattagaatggcaaaattcacagttgattattgtactgtactgtgggggaatagcaggaaacaatatggtgggactataaattggtacaagcactaaggaaaataatttggcaacatctaccaaaattataaggggacagaaactttgatgtagtgattcaatttctagcaatttaccctacaaatatttccaaatgtaggaaaacaaagtatctacaaagttatcctctgcagcactgtttctaatagagcaaaatgtaatcattcacatacagtcaacacagcaacttttaaactgatataatttcttaatacactgttagatttttagggatcagaataataaatatggcatgctatcatttgtttagtaaaaggaaatacataagtatatatgcttacagttactcatatatgtgtataaatatacatatgtatatatatacacacatgcacccctggcttgtattaaataatatctatggagagatacacaataaactagtaatactgcctacaaagaaggcatttaatagttgaaaagatttttcaatcttttgtactttctgaattttgaaccatacaaatgtattatctattcaaaacaataaatattaaaacaataatatctgatagaaatagtaagaatactggctaaatcaatttctccaattaaaatccttcaacaattccccatctccaaactcctcacttttgacattcaaagttttcttatggcatcatgcttcttttcaagtatatgaactatgctccagaaaaaagtacctcagcctctagtcaaataagacagctttcctcacattttactaagaatttctttttttttttttttttctgagacagagtcttgctctgttgcctaggctggaatgcaatggtgccatttcggcctccgaggttcaagtgattcccctgcctcagcctcccaagtagctgggattacaggagtgtgacaccatacccagctaatttttgtatttttagtagagacggggtttcgccatactggccaggctggtctcgaactcctgacctcaaatgatccacttgcctcggcttcccaaaatgctgggaatacaggtgtgagccacagcgtctgacccagaatttctttctttttttcttttttctttgagacaagcctcactcagtcgcccaggctacagtgcagtggcagtatctcggctcactgcaacctctgcctcccgggttcaagcaattatcctgtgttagccttccaagtagctgggattacaggcacgcaccaccacgcccgtctaattttttgtatttttggtagatatgggttcgccaggtcagccaggcttgtctcaacctcctgacctcaagtgatccacccaccgtggcctcccaaactgctgggattacaggtaagagccacagcacccagccactaagaatttctttaaagccacaaataagcaattttggacataataaaattttgtgagccacatataaacaattttagagtatatgaatggaaaagctcaacttcgatcaatctggaacacatacttaggttaagcattaagctctcatcaggtgtttcagatattctatagacaggctgtcttgaagggaaacatggtaaaggcatggcaacaggtttcaagaagtcttttggcgctgtatgcagctacaatccatacatacagttctgcctaagcaataaataccatcttgaatagtgggaggggatccatttatcttctcaggaaaaaagttctttatcttcctttattcgaaaaagcagaaagcaaaaatggaatttctattagacttttttcaaaatattttttcttctctgtaagtctattcagacaatattcaacagattttgtagtagaaactaccaacaggtaaataaagaatgtacattcgtgaaaaggtgtcatgttcatgacttagactagaaggcaggagattagacagggcaaaatttacttggaatacaatgtcaatgtactattcacacgacctcaaaagaacttctgtggtcaagtccgacgacctttattaaattcctgacagtgacttttaacgtgaaaaaaacctgttttcccacaaaataggctccttacatttcacctagaacaatggatattttaagtgaaacagatctgtagaacctctaaaaccagacaaatgtaaactagaaacaaggagttacttctctccaaatttggctcccctccatcagctctacaatactgctgcatcataaaaaaaggtcattaacttagattggatgccacttttaatccttcataaacatttctaatgaaacataccaaggcaataaaaaatatttctgcttcctaaagcagatcttaaagaacaaaaaataggcctgcaaaaaaagttatgataaactcttaaagtagtacaacaattaatgccttacatatggaaactgtgtcaaatcatggaaacagaaatctaagattacagggtaaccagctaactactactcatattcgcttcctaattaaaatttatcagtaatttaagattggacacaacataagcaatgcaaatgcttgcttatccatactaagattcctattattttaatcccattaccgctctagtttttaaaaataccgtaatgtccaagaatcgctttgttaatacagagtgtcttagagaattaacatttaaatgagattaaggtattttccctgcaaacacttaaggtatctgtgtaatctcaatataagcagttctacgcacatctcatttccaggatgatttttaccattttgcatgtcattccttcccccaagtggaactcacctcagtgacacaggacgttagtaggaataacggtgatgactaataagcatcagtctaggtgtggcagtcttcctacggggcttaataaagcagaggtaccatcccgcattttgaaaatgacatcctgaaagagaaaccaagactgtctaaccagcagcagctcacagtccagactgaaagggggcactgagactctccacacctgacactcgtcttcagttgataccacgggtttgactccgtcctgtctcgggcgacgcccgtaagacaggtcgacactaccccgacgaaacaaacaaactggtttctgagccccgtagaaacggcggggtgcagcagggggagtgcctccgttaccgcctctccaacttcacagaggtcgttgctagtggccacggcggggtggggacgggcggcgttcgggactgggaagctacttgactgccacgtgctcctgcctcgcaacagcggctctagattccgagttatggggacaactgctcgagaggccagggtagggtaaggactccgcaacctagggtcccaaaaccctggagcgaatgcggactaagggagagcggccggcgcgtcaccggcgctggcgtgtgacgtcagcgcgtggaaggcggcacgcagcggaggcggctgggaaggagcagtgaggctgggctagaaccgtagggtcgggcggggtgctgtgcgaaggggcgggcggggtgctgtgcgaagggacgggaggggcgggctctgcaggcgggaagacagaaaggacgagacgggagagatgaaaaggatggagagagtgtaaagctgttaagagtcatgcagagatgcgggagagaactcactagttgaaaccaatttggaatataaagcatataaaattttcccacagctactacaccgagaaagggacttttttattttacatgaaagcgcactacttagggatgccacattttaaagagcaattttgctttaaaaagcaagtcttttcctattatatcttggatggttgaaacagaagaatgtttaagtcttgagatatttttaaaaagctgtatggggttttctacacctttacatctaatgtatgtataaattacttgtctgtatgttgaagggtttggaaatgtacagcagtctaagtacattttttcactgcaggactggcgaaggtaggaagagattcccctaaaactataataagggatatcatctggcgtcatcctgagtggccctactcagggcaactttattcctagggacattgaaagattttggcggctttgccagacgatggcgctgcaagtcacccaacctgaaaagctggagagtttgttttatctcctcttcaatcgccatacagctacaaaagacttattttcctcattctttctacttctagtctacactcctgtgggccctcctacccccagttagtaggaattatcatgtctgaatgcacaattgtagttctacccacatccttttgtacatcaaagtgaagtgaaatgttgccaattactaatctaagcaaattctttttgctgcttacaggaagaatggctagtcagctaacctccttagataattctttaggctcatgtcataaactattggtaggactacaaactgctacagtctttctagaaggtatgctagcagtatgcatatcctttgactcagcaatttaacttctggaacaagtgagcaatgatttatatacaaggataaccgttattgtttataaccagaaaaactagaaatactgtaaatgtataacaataaagaattgattaaattataatatatccaaacaatgaaatactctaaagccatttaaaagagtaatcaagatctactttattgacatacaaagataccattgatatattgatgagtaaataaagcaggttacctaagaagattacctgatttccctttctggtttatatacccctgtacaattgatttttttttttatttttaaacaagagtgctttggggtttctttttctttaaatattttattggacttttctttcaaacaaaaaagtttttgcttcttgcaacaagccagtaacacaagtacacaaagataaagcctatcgtctccttcccagagctcttctgtgctgtcctccacgaaaccaatgttaacagttaattaatatcatctacatttttctctaagttcctaaaaacataagcatgcatttttatattttatatattagtcttagtcttttatttacttatttattttggagacagggtctcattctgtttcccaagctggagtgcagtggcgcgatcttagctccctgcaacctccgccttccaggctcaagtgattctcccacttcagcctcccgagcagctgggaccatgggtgcgtgccatcacacctggctaatttcggtattttttttgtagagatagggtttttgccatgttgcccaggcttcttgtgtgtgtgttttgtagagatgggttctaccatgttgctcaggctggttttgaactcctgagctcaagtaattctgcctgctttggcctcccaaagtgctgggattacaggcgtgagccactgtgcctagccgggactatagtatacatattattttgcaacgtacatttttaaatttaatagtatatgaacatctatgcggatatcaactaattcttgtgaatgatattgatatttcatgatatggctataccaaaatctactccattcagtagacatattgtttccaatggtataattacttctgtgggatagatttcgaaaagtaggtttgctgggtcaaaatgtatgcatattttttcactttaacactcctatgtcttggttatgaaaatttcttaactccttattaatagtggtagtacaatatagtaaatggaaggggactagcagtatacctaagctattctactagatttttcagaaatatattctgccatgcattcacaattaagcactatatgttagatgatggggacaaacatattcaaagaatggatattgttattccttctttctagaaagcaggcagcaaggtgaaacaaaatagagaataacaaattagagcaaatggttggtatagaactacactattttccctttgtgaaattattatgtaaatgattttattaagactatgtatttatgaaggcataagttctgattatactcacctaaaatctttttttttaaattatactttaagttttagggtacttgtgtacaacatgcaggttacatatgtatacatgtgccatgttggtgtgctgcacccattaactcgtcatttaacatgttaatgctaaccctcccccctcctcccaccccagaacaggccccggtgtgtgatgttccccttcctgtgtccttgtgttctcattgttcaattcccacctatgagtgagaatatgcatacttacctacaatcttttgtgattagagaagggcctaaaatactaaatatgaagaaaagcattctctaaaatccagatcttttacagacatgtaatattcaaatccaagggagaaaaaaaagtcaatgtcttggcatttagtactccatcttgctacattctaggcgagaaatttttagttatttaagccacgttcctgaaagtctactctagccttatgtggtttgaactcactgttaactctgcatagctacgagttaaactgtagcagcctactgaatttctggatcttaatctggtaggcccagctccatatgcaaagataaaacatctagtcagcttttgagtttctggctttctgaattgggtcacctgccagggctcacagatgagtccaccacctgaaaagaatgatcataatctgtatctaggatgaataaaacaaaacactgtgcccttagttgtgtgcagcctgagaaatgagtcacttcatgagactgttttcaggatatgattggctgaaagagctttgagtgtatcaagtcctactgaggcagttttgtgggaaacaatcacactaaactggaagactgtttgccatgtcaaaggtctcgaattgtaattagaagtgcaaagctatttcggataacttcttgttatttttggggaaaagacaaaagacaagaaaaggtcattttcacttctatgatgttagtggaatcaggaggaaattctagactagaaccatgctactattttcataatagaatgttttaatcccttctattctctctctttccaatgtgtctgaaacataaacaataagatcaaagttctttttcttttctttttatttttgagacagagtttcactcttgtcacttaggttggagtgcagtggcgtgctctcggctcactgcaacctccacttcccaggttcaagcgattctcctgcctcagcctcctgagtagctggaagtacaagcatgcaccaccacactgggctaatttttttttttttttttttttttttggagacagagtctcactctgtcaccaggctggagtacagtagagtgatcttggctcactgcaacctccacctcccgggttcaagcaattctcctgcctcagcctcccgagtagctgggattacaggcacgtaccaccgtgcccagctaatttttgtatttttagtagagacggggtttcgccatgttcggcaggctggtcttgaactcctgatctcaggtgatctacccatctcaggctcccaaagtgctgggattacaggcatgagccaccgctcctggcaagatcaaagttctttttctgaaacaactcataaatacatgaagtagagctatacaatcttgtttggtttttctgtgcaactttttttaagtgtattcttttaagttgttatggtaagtaatcctatttctaggtttttttatttcaagggaagttcagagtaactttactggtccagggagcaagatagaagaaactgagatatgattcccagtgctctttactttgccacttctataaaatagcatcatccaacttgccactcccagagagagaattgctgacagagggcaaggtttataccacctccactcactggtaatgtctatcatttgtttctcttgtttcaatctgccagggttccagatatactagtgaacaggctatcctacacctggttgtaattggtaaactcttacactgtgagtcaatctttttgtcctttttccctttccttgaggccccaagagttttgttggttggttggtggcagaagtgtgaagctaatttaaatattggttgagtattcgttattaacttaaactccaaccagtcctagcccaaaaatctgatttacagtggaagaaactgacccttttcacataacttattttgctgtgtctccaaatacttcctgtatactgggggccttttaaaaaatgcatactgagacttgtggttaaaagatgaatttaagcaccctatggtaggcaagataacaccccctgccccaccgccccaatccctggaaccagtgaatatatcagattacatggcaagggggacttatatatgatatgagaaacattcagccttccattgctggctttgaagatggaggaagtggacaatgagccaaggaagtcaagtgacctctagaagctgcaaaaggcatggaagtggattctcccctagagcctgtaaaagaaaacagccctgccaacaccttgattttttttttttttttttttttttgagacagagttttgctcttgttgcccaggctggagtgcaatggtgcaatcttggctcaccacaacctccacctcccgggttcaagtgattctcccgcctcagtctcccaagtggctgggattacaggcatgtgccaacaaacttggctaatcttgtatttttagtagagatggggtttctccatgttggtgaggctggtcttgaactcccaacctcaggtgatccgtccatcttggcctcccaaagtgctgggattacaggcgtgagccaccacatgtggcaccaagaggttgcccagccaacatcttgatttttaaccagtgagccctatgtcagacttttaccctacagaactctaagatcaaaaatttgtactgtttcaagccactaaatttgtgggaatttgttacaacagcacttggatactaatacaaactcttcttagggttctgggagcagttatttacggtacagagatcaggtgggctgttaaattattttcatatgggagaaaagcccacagttggatctgtaaacctccttactgggaattatctcagccctaagaagttccttcttaatcactcccactaaaataagggatgtggtaagaatgccaatcaatcagcatcctttctgtagtatttaccacgatggaatgagatcaggctgaaagtattcacattagggcacttaaaatgtaccaaagatctggctatggtgcttaccctgtgtttcctcccaccagtctgttgaacaggaagttcaacatcaccagattctctgacaaaaacaccagaggaattacagagaacgttttttcccagatgcgatctattgttttatcaccaagcaatcacataccacattgtttaaatatattgccccatatgtaacacagtgtttctgactgagcaccttggatcaactgggaagagttaaacacaggaatgcttaggtccaacattgaaacaattaagacaggatttctgggagtgggacctaagcaaggatatttttctgaagctccctagatggctctgatgcaaagtgaagattgagaactactggtgcgatgattatgtatgccagagaccatgactttaagttcttataaaggaataaggtagtacataatagggataatattacaaaaaaccaaacgtacaaatagacttgttcttgcacacttaagagagatccttggaacaatcctccattaagaaactacgacactaccatgaaataatttttcatccttatagaaagcaggtaagattgactaatagaccacaactactgtctacattctcaaaatccatgtgcctttccaaaattagctacgtaactacagtgagagagaaaaaaaaatgtgagtaaatgtcttgtgaaaaattccacttggtttggaaaaatttttgcctgcttttccacattttctaagaagaatctaaagatcttggccaacagtgtcccaggtaagagaaaatcgtgcttgggtatttccatagttctacaaactctacctggataaaagtaatgaaagaggtcctaagaagcttgaccgcactgtgatcaccaccatgggcactataccagctctgaagcccagaactgtctttgagaatattcaatgctgccctagaagaaataggagaacaaaactcacgtgttcctagcctgcaaaacagtcggtggagcacgtatatgtaaaaatagaaaaggctggcaagaccaggtcatatttaatattcatgaggcacaagatatacaacacgcacttaatattcattaatcagtatatattcataatatactaaatatacaggagatattaaacgttcacgggtcttaattctgccacccagtggagacactcaaaagtgatctcgccaaagaaatgcaaaacctgtacctgcccaccaggctattagcatgctactgctgtggccaccattctttcactgcatcgccctgccctgcatcggaatatagcaccttgaacacgggatcaggtttactgaattctgtgacccacgctgggagctcaataaatgtttgctaaacggaaatgaacccaattcagaccgtgtagaaaccccagattatatcttttctccaaacattcaatttccaagcagtatttttgaaaatgcgtgatggctaaattcgagttatcctttttgtatgtatgttaggcacacaaccggcgatgacatacaaggcgaggtgacaccactgcactcccagcccgcacgtcacctataagcacagggggcttttggtgctggtttatttttgaaggctggtacttctcttcgatctaagttttaggaacctgtgctcgtcgacggctgccaatactttttattttcaaggctgacgctcgccagagtttcacaagctgctcccggacgctgtggtctctcgctagagtggatccgaactctgcgtgacgctgggaacggccagcgtctgttgcctcacgaaaacatctcccacaaggtggccgcctcgcgcgaggtcagcagcagggcaaacagggatgcgtgagtgactgacgtgagctaatcgctaatgacaggcttcacagccccggcggccctcagagccaggcacctcgcacccctcctcctcctcgagacccagtcccggcccgcccaccgttcccacgccgcccaataggcgccgacgctactcagcgagtggccggaggaggaggtgttgggacggccggacgctgaacggccgttcacgtcaacgtagtgacgtcacgcgtcgacgctggggcgtacctttcgggctcctgactcctgccgcttctcttccccttccgtgggtcagggccggtccggtccggaacctgcagcccctttcccagtgttctagttcgcccgtgacccggaataatgagcaaggagggtgtggtgggttgaaagccatcctactttactcccgagttagagcatggattcagttttagtcttaagggggaagtgagattggagatttttatttttaattttgggcagaagcaggttgactctagggatctccagagcgagaggatttaacttcatgttgctcccgtgtttgaaggaggacaataaaagtcccaccgggcaaaattttcgtaacctctgcggtagaaaacgtcaggtatcttttaaatcgcgatagttttcgctgtgtcaggctttcttcggtggagctccgagggtagctaggttctaggtttgaaacagatgcagaatccaaaggcagcgcaaaaaacagccaccgattttgctatgtctctgagctgcgaggtgagttgcattgtatgagcgaagagttgtcagctctcctgttcacagattttgggtcaactgtgaggccacagcgctcatcttggtttctcttacaatgtacctacataatgttgaaaggtacatcgtgaattgggatgctaacccatcctgattaggtatataccctcagacattctttaaaatttcacacatctgcttcaggaaccgtcgaaggacctctgaataaaatggaagtgggttccaggagaagattaactttaaacttagaggagtgggttttactttcgctaaattttccccaatttaaaaataatattcagtttttctatctttagatatatatgtatgtaaaatattttttgtgtatatatatttgtggtttgatcttaaacttgaccagaaactgccttagaatctcagaaattgactttgcatgtggtatgctttgtttgtatggcattttaaaactgcggagcatatagaagataattacatatgcattgtgcatattagaaactgagatttctgtttcctttagaaagaaattcctgttcatggaattgaatcaacagcgaccataccttttacacagatatataattcaaaagttcagttctacaaacgtaaacttttggagctatgcagttcagttactgcagcatcattgtggcttgtataattgttgaatctttccagaaatgcttttactttcatctttaaagagttaatttagaagatttttttttatgaggtcggtatggaaataactgcgtccctttgtgagtcactacaaaataatatttgttcagttcaggagtacatatgggagttaaagtgcttgtgtataaattgttgactttcatcttaaaaggtgctgctgctattcagtgtcttgttctataatatggctttaaaaaccatgtgtgtgacctacagatattttctcaacttgaatatgcgtatatggcctctggttaatacagacagccactgttggcagaattcatcacagattgcatacccttcccaccccttactcccctcagcacctcgaaaactttgctgctttacttgaatgatgagtcacattattttaagaagtcaatatgaatgtatagtacctacatttttacttggaaattgtacttcagtatgtgttatcagtcatacatagctcattaagaatgtaaatatttaaactacttttggatagatgtggttcaggggaacagatttgttgatgttgtgggtttgtgttagtaaattggctattttccaggtcatgttagtggtaggctttccatttcctgttgtgacatgttggtcataattttcagacggctcaggaagccagatttgatctctgtggtgggtcttatatcaaagcagtatcctgtggggtttggccactatcgctgttttgtagaacttccaacttagtttggtagtcaaacttgtcagcagtgatctaaaatgtataatattttataataagtgttaatatttgttgaatgcattctgtgttttcaggctcttttccaagtaatttttgtgaattatctcaattttcacactaaccccacgaagtaggtactttcactaatcccgttttacattcgtagaaactgaggcacagaaaatttaactaacttgccctacagtaactgtcagaactgagactgaagcctgggagtatgatttcagagttcctgctctctgctgcaccatagtgtagtttagaatagtcaaaatgctagagaaaaacaaggagggacgtggcttgtaggttcaattataaaagcaatgtaaaattacagagagtctgggaaacagtgtttttaaaaggaatactcataatcttactactctaataaacattttaattttttaaatatgcacattcacatctgtacataaacattgtagctgtgattcattttggttcttaaagataaatcttcagtgaagtttaatatggagattgaaccccactgcctcactttcattgttgaaatccagagagatttgatctgcaactttgactggaaccaagttaaataaatatatttcttgctatttcttgtgagaaataatcgaacagtttctgtcttttaaaatcatgaagactatttagttttcaaagtttctgtcttccacagcaactttttattggtttattgttttatctttcttccttgttataatctgagtgttatatttgtatgtgtgtttattccgttgtcctcttgaaagcctctagcatttatacccgctgcccctgaggaatttgggtttttttgtctgtttttatttatttttaattgacagataatcattgtgtatatttatggggttcaatgtgatgttttgataaatgtatattttgtagaaaggttaaatcaagcaaattaacacgtccatcatatcacctacttgccatttgtttgtggtgagaacgtttaaaattaacttttagcaattttgaggtatatagtacattattattaattatagtcaccgtggcatgcaatagatctctaaaacttactcctctaactgaaacttggtattctttgactaacctctctcctttcctttttcccccttctccctagcctttgtagaccaccattctgctctctgcctccctgagtttgacttttttttttagattttacacatatgtgagatcatgcagtatttgtttttttgtgtcttatttatttcacttagcattatgtcctccgggttaatctacgtttttgaaaatgacataattttcttccttttaaaggctgtatggtattccattctgtatatatattacattttctttatccattcatcatagatccttttagatatctctaatatcgaccttaaatgcagaagatgaatcactgtattggaagaaagaaaagtaatcctataaaatcagtttaaaattaggtcagtatagcaaggattagatatgttgattttactttgggtactctgagaacttgatttaaactgaaccttgcccagtgctaatgtaatcagtagaccacactaattcctatggtatagtagtgactttttttttgagatagactcttgttctgttaccccagctggagtgtagtggtgcaatctctgctcactgcaacctctgcctcctgggttcaagcgattctcatgcctcagcctctggagtagctgggattacaggcacgcgccaccactcctggctaatttttgtctttttagcagagacaaggttttaccatgttggccaggctggtcttgaactcctgacctgaggtgatcgacccgcctcggccacccaaagtgctgggattacaggcatgagccaccgtgccgagccaatttttgtatttttagtagggacagggtttcaccctgttggccagactggtctcaaactcctgacctcatgtgatctgcccacctcggcatcccaaagtgttgggattacaggcatgagccactgcactgggctggaatacatactaatttttagaaagctattacagcatccctcttgaggaaaatgtataatgtaatttatgctgaagtctactgaaagctgtagggcctatacaaatataatggcattaatacaataaaaactgtgttcatatttattataatttctggtacattgttagctattctataaatgttagtaaatgaataagttatgttgaaattccttttcacatttttttttcttttgtttgaggctcagtcttgctcttgttgcccaggctggagtgcagtggcgcgatctcagctatcctcagtctctgcctcctgggttcaagctattcttctgcctcagcctcctgagtagctgggattacaggtgcccgccaccatgcccggctaatttttgtgcttttattagagacggggtttccccatgttggccaggctggtcttgaactcctgacccaggtgatctgcccacttcggcctcccaaagtgctggaattacaggtgtgagccactgcacctggcctcttttcacgtttcaatctgtgactagtacttagcacagtttttacaatatttatatgaaaatgctccttacatacaaatggctagctcagattttcacctctctgccatcgttgctcttgagacttttgttccatctctctagttgctgacattgacaatctttttcttctttcacccagtttatatccacttttctttttagcttaacagagagttgactgacacacctttgggaattagatgtggtcctcagctgtacccagtcagtctcctttatgggagagacaaaactttgttgggaaccatgaaaaattagtgtgcatatctcaggctgtggatcctttcgccacccatttccatggttttcctatttttgctcccctccccaaattctggtggcatattgcttagtgtttgcagttttggggctcaggtcagtgtaatggaggtaaccttctttatagtctgacctggaatagaaactaaagcctcgacatataatcctaaagttggaaagaacacgctggtcttgagttctgtgagttgcaggagactgaaatttgtttctgccaactgttttcagttaatcaagttggaaccttagtggatatcttagattcttctttaccattccctatatcttattaattaccaggtcctcttaaatatttcttcaaactctctctgcttctcaatattgatgtgtcttagtgagcagggtaaaatcacagccaaagtattttttaattctctcactcaacacaacaataattaacacagaagacttctgtgaccagatgcttgggggtttctccccccacagcaaccaaccagttagttctgcagcagataccaactgggtgccccccggttccaatacggtgtacctggaggtagtgtcagacaccactggttgagggcagttcccaaaagacttcccccacttccagtgctaatcgcaagccccaggttattttgattttgcctgtgcttctgataacactggctataaatcagggatcccatgacccccccactccttacgtccttgggttcaattaatgtgctagagcagctcacagaactcagagaaacacttaccggtttattataaaggatgttcaaaggatacagatgaacagatgcatagggggagataggggaaagagcatggagcttccatgccttcccatggtgcgccaccttccaggagcctccaatgttcagctatccagaagctctctgaatccactccttttgggtttttatggaggcttcattacataggcacagtcaacaactgtgtagaaatgtgattggacaaaaagagtatgacctaacagcactaatagacccagtggggaaacccagcaaggcctgcctgtccaacttcttctgcctgtctgcagcattccttcttccagggtctggggcaagctcccttctaaagggaaggtcttatgacccacagtcagacaggctgtggaagattagagttctgccttgggttggtggaaaggagggcaggaaaaggtcagcaagagaagagattctgttttctgaggtttaatgtgccccaacattatacaaaagactgtagtaaggccaggcacagtggcttacctctgtaatcccatcactttggaaggccgatgtgggcggatcacttgaggccaggagttcgagaccagcctggccaacatagtgaaatcctgtctctacttatataaaattaaatttaatattaaaaaagaatgtaataagagctgtgggacttataaaccaggaaccatggatgaaaaccaatatatatcatatcactcttaattcagttatgccctatcttacgtttagaattgttcagacgtctagtctcatctccagcttctctatctgtagtccttcagtctcttacccttcttatctggctttcacactgctgctagtgttggcttactaaaattcatgtctgatcatgtgatttctctaaagttcttcatggtttcccctgtgtatagatgagtatgtaagtttcttagtgtgacacatgaacccctccccttcatgatctggcctatgtctgcctctgtagctactctctggtcctttacctcttacataagctacccaagcaggttttactatgatgcttttatgctgttgcgcatactttttttgtgtgtgtgcctgtattgactttttacctcacagcccaattaatttatcctaattcttcaatattttgctaaaatattccctctattaagtgcttacggactgtgtgccagccagcttgcttacttttctcaggtttatcaaatacattgtatgtacctctcctgtgatgtgtatcataccatattgttgttacttgttgatgtctgtcaccttcactgccttaggaacagaaaccatatcttattcattaccctagcatctggctttgtgcctggtacatgctaagtgtgcagtcaatgattatcaaataaattaataaatgactccaaaaactagctttgaatactagataaatggtgatcctgtaaactgagataggaaaagtaggaggacaaggacttttggggcaaatatttatttagtttaggtcttgttgagttttagctcttttacaacatcaaggaagacatgtaccatttatttcttatacatttgttatttattcatacaatataattaacccaacaagattttttttagatatggacaagattattctaaaatttacatgaaaaggcaatgaaaaagaagaataaggtgtgaaagatcaatctactcaatttcaagacttattatgtagttacagtaatcaagactgtgtggtatgggcatagataaagacacagatccgtggaacagaacagagaactctgaaatagatccacataaatatacctagtttttgtcaaaagcatgaaaacagttcaacggaggtagataactttttcaacagttggtactggagcaattagacatccatacactgtcccattcccaaccccccaataaaggaacctcaacctatgtctcataccctgtgcatgcacaaattaaaatggatcacagactgaaatataaaaatattaaactataaaattttaggaaaaatagaagaaaattttggggaggtagggttaggcatatgtttctttgacttgccaccaaaagaatactccttaaaggcaaaattgataaattaaacttcatcaaaattaagtatttttgctctgttatagaccctgttaaaaagatgaaaagataaactagagaggggagaaaatatttgcagacaacacaactgacaaataactagtatctgtaatatataaagaactcttaaaagtcaacagtatgaaagcagtccagctagaaaacggacaaaagacatagtcatttcactgaagaggattacacatatagcaaatgagcacataaaaaatgttcagcatcattacccattagggagatgcagattaaagcaacaagatactaccgtacatctatcagaatagctaaaataagaaatagtgacaacaccaaatgctggcaacgaggtcaagaaactggatcactcatacattgttggtagaaatgtacaatggtacagccactctggaaaacaatttggcagtttctttaaaaaacaaatatgtgactactgtatgacccaactattgtactctgacatttagcccaaagaaataaaggctattcattttcaaaaacctgtacatgcatgtttgtagcagctttattcatagtcaccaaaacatagaaacaagccagatgttcttcagtgggtgaatggttaaacaaactgtggcatatctgttatcatagactactctgataaaaaggaaggaactattgacacatgtaacaccctggatgaatctccagagaattgtgctgagaacaaagagttaatccccatatcatatcatttatataacattcttgaactggcaaaattattgaagtagaaaacagactatgggttgctaggggttaaggagggatggccataaaacggcaacatgagagatacctgtggtgatggaatattctgtatcttgactgtatcaatgtccttatcttgattgtgatattgtactatagttttgcgagatgttcccattaatggaaactgggtaaaagatatacaggatttttttctgtattatttattgtaactacatgtggaaccacaattatctcaaaataaaaatttaattaaaaaaattgaacatctactgtgacacattttttttttttgaggcagatcttgctcagttgcccaggctggagtgcagtgagtggtgtgatctcagctcactgcaacctctgcctcctgggctcaagtgattcttctgcctcggcctcctgagtagctgggattacaggcactcaccactatgcccggctaatttttgtatttttagtagagacggggtttcaccatgttggccatgctggtcttgaactcctgacctcaggtgatctgccctcctgggcctcttaaagtgccgagattacagctgtgagccactgcgcctggtctaatgtgacatattttgctaaccattgagtatacagtgttgagcaaaaattgagtgtcagacctcatgacacgttctacaatggcagacagatattaaataatcacagaaataaatttaatattcaactgtggtaagtgctgtaaaagagagctataagaactaataatgagaaaatttgatccagatagtaagtgggtcagcgaagctttgcttactaactgcatgactttgggcgagttatttacatgctttgtgcctcagttcctcatttttagtggggacaataatagcacctattctttaaggttgtcatatatttaatatgaatattaaatgaatgaatttgtaaagggcttaagatattgcctagcatatagtaagctctggttaagagtttgttaaataaagggatacttgatgtaagaccttgtaagaaaaatgagtaggagagttaattcttttttatttttacaatttcaacttttattttagatgtgcaggtttattccatgggtatacagcatgatgctgcggtttggggtacagttgtacccattacccaggaagtgggtatagtgctcaacagtttttcagcccttgcttccttccctacattgcccgcgctggtagtcctcagtgactattgttgccatctgtacatctgtgagtacctgatgttaaagctcccacttaaaatgagaacatgctgtatttggttttctgttactgtgttaattcacttaggataatggtctccagcagcatccccattgctgcaaaggacttgattttattctttttatggctgtgtagtgttccatggtgtatatgtaccatattttcttttctttcctttttttatttttatttttttttgagacagagtcttgttctgtcgcccaggctggagtgcagtggcacgatcttggctcactgcaaactctgccttctaggttcaagcaattctcctgcctcagcctcccgagtagctggaattacagacacctgccatcactcccggctaatttttgtatttttttagtacagggtttcaccatgttggccaggttggtcttgaacttctgacctcaggtgatccgccagccttggcctcccaaagtgctgggattacaggcgtgagccaccgcacccagcctgtaccatattttctttatccagtccactattgatgagcacctaggttgattctgtgtttttgctattgtgggtagtgctgtgatgaacatataagcacatgtgtcttttatgtagaacaatttattttcttttgggtatatacccagtaatggcattgctgggtcaaatggtatttctgttttaagttctttgataaatctccaaactgctttccacaggggctgagccaatttacattcccactgacagtgtataagcattccatagccttgccagcatctgttgttttttggctttttaataatagccatcctgactggtgtgagatggtgtttcattgtggttttgatttccatttctctaatgattagtgacgttgggcattttttcatctgcttgttggacagttgtatatcttaatttgagaagtatctgttcatgtccttgcctactttttttgtttgtttgttggagacggagtcttgctctgttgtcgcccaggctggagtgcagtggcgcaatctcggctcactgcaagctccgcctcctggtttcacgccattctcctgccccagcctccggagtagctgggactacaggcgcccaccaccacgcccggctaattttttttgtatttttagtagagacggggtttcaccatgttagccaggatggtcttgatctcctgacctcgtgatccgcccacctaggcctcccaaagtgctggggttacaggcgtgagccaccgcgcccggccgtctttgcccactttttaataatgttgttttttgcttgttgaattgtttgcttcttgtagattgtagatattagacctttgtcagacgttagctagattaacagagaaagagacaagatccaaatcaccacacaatcagaaacaacaaaggtgacattacaaccaatcccatggaaatacaaaagatccccagagactattatgaacacatctgtaaacacgaactagaaaatctagaggaaatgggtaaattctggaaacagcctcccaagattaaatcaggatgaaattgaaatcctgaacagaccaatatcgagttccaaaatggaatcggtaataaaaaatctaccaaccagaaaagccctggaccagatgtattcatagctgaattctatcagatgtacaaagaaagctggtaccaattctactgaaacgactccaaaaaatgaggaggggctcctccttaactcattccagcttcaccccgataccaaaacctggcaaagacacaatgaaaaaggaaaagtacaggtcaatatccctgatgaacatagatgtaaaaaccttcaacaaaatattaagagagtgagttgttaaagagaagagggtatgatccaggcagagggagcaacaaaggccttggggcaggagtcaggaaagagcttgataggactgagagattgaaagatcagtgagtctagagtacttcaggaagtacatacttctcaaagtaagatatacaactggccaacaagcatgtgaaaaaatgctcaacatcactaatgattagcgaaatggaaatcaaaaccacagtgagacaccatctcacgccagtcagaatggctattaaaagaagctggggccaggcgcggtggctcaggcctgtaataccagcaatttgggaggccgaggcgggcggatcacgaggtcaggagattgagaccatggtgaaaccccgtctctactaaaaacacaaaaaattagccgggcgcagtggcgggcgcctgtagtcccaggtactcgggaggctgaggcagaagaatggcctgaacccaggaggcggagtttgcagtgagcagcgatcgcgccactgcactccagcctgggtgacagagcgagactccatctcaaaaaaaaaaaaaaaaaaaaaaaaaagtgctggggaactagcaggggttgggctgcatagaactttttctgctatattaaagagtttgtttcttaagggtagcaggaaatgattaagagatgttaacatggaatggagagagattatgagcaaacttactttttggaaaaaaaaactgtgctggctgcagtgtcatcagattcgaaggaagcaaaataattgcacgtagataatataggaatttattaggtaaacgaggccttattactggaagttttcatagtttatctctgattattattattactttgtttgagacagagtctcactctgtttcccaggctggagtgcagtggcataatctcagctcactgcaactgccgcctctctggctcaagcgattttcatgcctcaggctccttagtagctggggttacaggcggctgccaccacgcccggctaattttttatttttaatagagatggggttcaccaccatggccaggtgggtcttgagctcttgacctcaagcgatccagctgcctcggcctcccaaagtgctggaactacaggcatgcgccaccacacccagcttatctctaatttttataattttgtaagaatatatttacaagctactgtgtatctattacaatgttttgaaatgattataagtatatttttggtgattaaaatggaaaaggtgactttgcattattttttttaaatatgtaaaatttcatctgctgtgttagagtctaaatagccttttgtgcccaagcctgggaattgggtttagaacctgaaaatatttaacactagtgttcagatttccttctgttatatgtcctttatgctactatagaaatttgaatattttatagcagtgctgttcaataaaagtgttagtgctgcaaatgcaagccacataggtaatttttaatttttcagtagccacattaaaaaggtaaaaagaaagtggtgagattcatttcaaatatattttatttaacccaatggatctaaaatatttcaacatgtaatcagtataaaatttctagtcaaatatttgacatcctttttaaatattaagtcttagaaatctggtaggtattttacacttagagcacatttcagtttggaccagccatgtttcaatggctcgatagccgtatgtatgctggctgctgcatcagtcagtacagctctataggtttctgggttaatacgtggaatagttttttttttttatcttaagttatcaaatttatagaaatagaaacccatgcaggcctgggtttaattggtttatttggagcagagttgcatgcttgtgttacaaagaatgatctgcaggctaggtgtctcaaaggtattatgaaattaatttttttaacggaaatagttaaatttccagttaccacttacgatttttgagagacttttagggataaaatggaggagatatattggaatttgctgattgaagtattaacacataaaaaggtttaatgattttacagagatttcttagtgctgtgtagcctctagctaatgttcactgaaatgttatcatatgtattaagcccttctattctgtaaagaaataaaaacagagtgtctgtgttcttcacaaaaatcttagcatacatgctttgatacatcaaaattaaatgattcttaagctattaatgtttatgtttttaaaagccttttggtaattttctcaaaagccacataatatttaatttgtttgcctctatggaactgcagatttcttagtatgaacaactactttcatactttcctattgttttaattaatatactctaacaaatctcatctcagtataatatgccatctttggtagcgataactataaaacattcataaagttgcaaagcagcaagtatttacatttttcttttttaatttgctaattttggttattcctccaagaacagtttaatactcttggagagaggatttttttttaaattgaaaactgaatacatttctctttttgacctcattaattgaatagtttgacatttgttgttcttacactgtgccagtcattatgccagatgtggagagcagaggcatgctctcaaggagctctcaaaacttcacctttttcaaagtgatctttaagttaggaaatttatataatctgtttaaaagatatttattgtcagtaatagtctagttttctaaaacttcataaatacctttttgttattaaagctctttgaggttatctttccatttgcagaaggaaaatttactgagtagaagagattgtcttaaaacactccacgtcttcagtgttagaattcactgctagaattcatcactggaattgaactgtgcttactttagtcttcatctgtcattttctgtgtgtacttactaggccatatctgctaagtcttgttttacaaggcttactggtttgactgcttttatgactgcatctttcaagtcccacccatgcagcttaaaagtctattactaatgtccccatacttatgttgaactcttattttggtgttgagtaagtaagtggaggtatttaaaaatcaaactagttaggagtaatacagatttaagaatatggagagtaagaacaatgaaaacatacccttttttgatttgttgcctgttaccattttatcagtggctaatgtttgaccataggctctgaagatttaaattttaaaaggatgaaaggagaatgaaataaatattttaaaattttttaattgtagtatttatttttaaaatcaggttgtacttacacctcttacacctgataaaatattcaaaaggggcagtctgtctttcaaaccttgtacttcagccatcttgttccctaccctttgggcaacttacttggaactctctcctgagacaaatctatacatacacaagcaaaaatgtaaatatacgttacatttttcaacttaacaattggagatctacctggagaaattcttcattcttttttacaactgtataatgagaataaaattattacctcaccccaaaatacttaataaaggtaactattgttacagtgaatacgcttaattttttttagcacatagatcataactttccttttgtgatgttaaactagatgatttttattgtatgtttgaaaaatgttaaaactactttttcccccccacagataatcagacagctaaatggagtctgagcagctgttccatagaggctactatagaaacagctacaacagtataacaagtgcaagtagtgatgaggaacttttagatggagcaggtgttattatggactttcaaacatctgaagatgacaatttattagatggtgacactgcagttggtaagttcagcatgacagcctaatgtttgtattcatgaatatccactaataaatatgtacactattttattgaggttgaatttttcagtaactttaaaaatttgagatcaaatttacataacataaacttaaccattgtaaagtgtggaactgagtggcatttagcaggttcacagtgttgtgcaactaccgtttctatctcgttccaaacattctcaccaccccaaaagaaactactacatttaagggtaagcttttaaatataatgtaatacagagaggtgtgcaatcatcacatcttagtgtggaaattgatgaattcctacaaagtgaacatttattatataactactcctcaatcaagaagtaaaacattaccagtagtttcagaatccttccttgttccaccttcagtttcaatattattttgatttctatctagattaattttgcaagtatttaaactttatgtatgtggaattcatactgtgtactcttttatgtctgtggcttttacttacgtttcaaaatcatctatattgtcgtgtatagcaatagttaacgtattttcattgttggtgtagtgtcccattgtgtaaacatgcttcaatttatttagttattctacactgatatttcattatttggttttttttttttttttcatattttggctattgctaacagtgccactatgaattgtcatgtgcatatgttttagtgcacattatgtacacagttctgtatgatttatatcacagaatggaatgcttagatcatagaatatgtatatctcagcattatcagatactatcagagatacttccatttcttttttttttgtcaattaccctattcaaagatactaccaaagtggatatagcatgtacatttctactagcaatgtgtgagaatactagttactccacatcttcacctatacatgataacagtttttaaaaaattggctattccagtgtggttgcagtagtctctcattttggtttcaatttatgtttacttgatgatttatgagtttaaatgcctttttgtgtgtttattggctttttagattgcctcttttaaagcacctattcagtccttttccctgttttataggagttcattatgcattctgattatgaatcctttttcagatacatgtacggtattgcagttatcttctctcattctgtggtattttttttactctcttaaaggaatcttttggtgaagatatcatcaattctaatgaaatccagctaatcttttcctttattctaagccagtctcagtcacttatgcctgcaatcccagcactttggaaggccgaggcaggaggattgctcgaggccaggagtttgagaccaacctgggcaacaaagtgagactctgtctctacaataaaaatggaaaagaaaaaaaattagttttgattgcaccactgcactcctgctaggcaccagagcaaaaccccgtctcaaaaaccaaacaaacaccaccaccaccaacaacaacaacaaaaactttttcttttcctttattcttagtgtttttttttgttctgtttaacaagtcttcccatacctcaaggtcacaaagatattctcctgttttgttctagaagttttatttttgtgtattcacatttagatctgcctacctgcagttaattttttaaatatgatgtgggttaagagttcagattcatttttttcccatatgaataactagttgaccccacaccatttgttggaaaaaactttgctttttctaatgtactacagtgacatctttgtcatgtatcaagtggctatatttttgtagatctgtttctggactttctactgtgttacattgaaataattgtcttatccatatgccaatgcccaggatatatatgagttttgttttttaaatttgtttttgtcttttattgatttatagtctgtttgcatttaacataatcaccaatatgtttggtttcagaccatcctctatttgttttctgtttgtcacatctgttctttcctctccccttatttctgttaccttcaaaaccttgttatatgttctcttactttttgttcagtaggctaccctagagattattacatgtatccttgatttattagttctaggcattggtacttttaccacttcatggaaaatgcagggacttcagaatactttacctctttttacccctttctgcttccttaccattttctcaccaggaaataggtcaagaatgaaaatggttgagactattgggttttacctttctttgtttcacttcttttcagaatattgacacttcaagttctggctcccttggatatttactggtttaaaatacaatattttgctgttatttgtcatttgctgtctttatcacagattttttttctaattttaatgacaaaattataaacaagaaaaatacatatattcataatttgaaacaggtgaaattaatagcatacccattttttctgtgtttaaatagctctttagccctttatgtgaggcagaaaattaactccaggaagtagaaagatataggaagagctgactccttccaccttcccacgttgccgtcaagtgctggtgatgtctttactcatggtcttcaacaggagagagtgccaagcagtaaggatggggcaagggcataaaaaggatctatttgtgttgctcttttatcagggaggataatttttctagaaccttatcattagacttccttatgtgtcactggccataattgggtcacatgcccaccccaagactgataactggcaaaggggaatgaaattactgattggttaggacaattatgattccttctctgaaattaggcactttaacatgcaaacaagaggaaggcccaattagcaagtataaagttggaatgactatagcgtaggcaaccattggtgttttcttttctttttttggagacagagtctcgctcttttgcctagtctggagtgcggtggtacaatgatggctaactacagcctttacctcctgggctcaagagatacttgtgcctcagccttctgagtagctaggaccacagttgcacaccactagacccagctaattttttaaaattttttgtaacaatggggtctcactgtgttgcccaggctggttttgaacttttaggttcgaacgatcctcttgccttggcctcccaaagtgctgggattacaggcatgagccactgtgcccagtctattggtagtttatataaagagtctgtcctcaaagttagtgtagttgaaggtataagttgtggagtagcagtcaaaaataactgtgtgagttttaaattcggtggtacagattccaaatgttacatgtcaccaaaaaaagatatcattttgatatccctttagaattgggaaggttgtaaagggaagataatgcatgaagatccagcaatagggataattattatatatgtgaaacagtgaatgtccttttttaagacagtgaatattctttctttcaacatagctgatattcttctgttaacagtagcagggaggggaatgtcttggaagaagttggagcctcacattaggtctctcactatgggttaaggcagatttcagaggaaaaaacttatttctgtttctgctcagtatctggggagtatggaagtggttagtaagtcaagcagtaattcttcgtgactccatatctttttagcataccaaaaaataactattaccagaaggtactgatagtgtttttttgaatatgtgttgaatgaaaatccatgatgttcagtggctttcaagttggtgacctgaatttacatcctggttctgtcacttattctctctctaacttttggcaagtcacatagcctgtttatacttcagtttattcccacgtacaacatagtagtaaactcctaaataataaagtctttaaatgattgctctgagaattaaatgcatatagagatcttaacaaataatgcatatagaatccttagcagtgtgactggcttatggtaaggtaaggactcactaaatagtagctgtttctgttttcttctagattactttccctttggatatgttagactctgtacccccaacgtaagcagttttcttttatgttcatgttcaaatgagatgtcagtaacatctctactagtattaatgaaaagctgtagctctagaactcaaatatgacatctggattaggatttagcttgtcagagataaactgctttggaatctactgacttcagtagatatctgttgcatagcccttgctttgaaagtaactatgtgtacttaataatctcaaaaatgtaatcaatctgctcagagtgagtgctaaacaatctagagtacactgattaaaaaatagaagttattctgtataatgatgactagtagtatcagtcagaaatgtcagctagcaaaaagctgaaaaagtaggcctgaaatgtgtttatattaggtatatctaatttgaatgagtcattttggtcaataattcagattccatggaaaatgcaaaatttttttattgcaagtaacaggaagggagagccaagattttgttgccagagttgtattcattaaagagaaccatatggctcttgactcattgaaaatgaagcacatgactgttcatgagtgcagctttagaattattcttataatagatagtactatcttcacttgaagtaagagaagttattgagattgactgatggggtaaaaactgtgatcagccatgtttaagcaaattaactttcagtagttaatttatgttgataacgtgattatgctagtaagtttaaaatttaggcgcctatatccttttttatcacacctgaaatgtttacttgacaacatcaagggtctcccaggtttctgattatgtatagactgagagggaaatgtgagaggagtaagagttgagagggctcactcctaagtgtttgatttcctatctatacataactttaaaaaataaaaataaaaacagccttggaagctgggtgcctgtagtcccagctgcttgggaggctgaggcaagaggattgcttgagcccaggtattcaaggctgtggggtgctatgatcgcacctgtgaatagcccctgcactctggcctaggcaacagtgaaacccagtctctaaataaaaataaaaaacctttggaaatactaaaatgcaaatgtgaggttttctgatttattgggaatcttggggcatgtgataactgggaatggaatccagagaaattacatagattattatattctacttcccatatatgtaacattctgagcttcagaactcagaaaccacatagtagacgaggctcagaggtggactgtcctggtcaaggtgttgtgatcctaccacctgtgctaaaacttaagctaccttctgagctattacaagagattccagtattttcattcaaatatctattgttagattgagctttattcaaaatatttgtaagtttattcatctggtattcttctgggtggcatattcataactactgcctacacaagacgtttcaaaagaagaagcttggcaaagtagatgcagagtgataatgccagaagctgagtggccatctcttagtgtgaagacacctcctagagtgagggtacacaacacaaatacagggtccagcctttcctcctgtaaacgcagaaacatggcatcaacatgaaactagctgtctctaagaggcggattcatattaactagggttttagatctcattaggtaaaaccataatacaaatgtatttatagtgagaaatatactaataatctacttcattccaaaaaaggatataaagcaacttaaagggataaacagaattcaatcatttgcataagtatctgacacagatgaagcaaagggaaaacaacttgaggtgacgtaaaatgtagatatgagaccaataaaagttaccaatatacattttaaaatttatttttttttttaactttaaaaaatgttttgtagagatgggatctcactatgttgaccaggctagtctcaaactcctggccgcaagctctcctcctgcctcagcctcccaaagtggtgggattataagtgtgatccaccatgcccgatttaccagtatacttcttgagaggagactacaaatttgcctctaaacttcatagcagcaagtaaataaaagaacctgtttagttaaatgattcaaagtgtttataaaacaaaaacctaaccaattgttcagcagacaccctattactaatattaagataaatctccggtgacattatgaagtgtttactagctagtgtatgaaacagtgatttttaggaatatgcttggagtaagcagtaaaatttcacagggctttgttttttgttttttgtttttgagatgggatctggctctgttgcccaggctctcttgccagacaggggtctgactctgtcacacccagtggcacgatctcagctcattctaacctctgcctcccaggctcaagccatcctcccacctcagcctcctgagtagctgggactacaggtgtgcaccaccacacctggctaattgttttgtattttgtttgtagagacggggtttctccatgttgctcaggctggtctgcaactcctgggctcaagcaatctacctgccttggcctttcaaagtgctgggactacaggcgtaagccaccgtgcccgtcctcacagggcttttattattaacattcttcaatatctcctacttgaatcacaagattccacaatgacaccattattatatagtataaacattgattatttgtgatgttctggtaggattcataggtgtattttagactatcttcgaatagatggactgtatagagagtttcaggaggtcatcaatgtatattttttctgaggtttgatatatattaggtaacagtgattttagaattataacagagctatattataaaagagtatattatttacatttagctagtttttctttagcaacagaacacaacccagctgaatgtaagactgaatagaagccaccagaagtcatcttaatgaaaagtaaaggctatgccaatgggcaaagtcaggagtcttcattcaaaataaaatatatatatatttttgaggcagagttttgctcttgttgcccaagctggagtgcaatggcgcaatctctgctcactgcaacctctgcctcctaggttcaagcaattcttctgcttcagcctcccaagtagctgggattacaggcacgcaccaccatgcctggctaattttttgtatttagtagagacggggtttcaccatgttagtcaagctggtctcaaactcctgacctcaggttatccacccgcctcggcctcccaaagtgttaggattacaggcgtgcaccactgcgcctggcctcaaaataatttttttaaaaaaattcagggtctcattctgtcatccaggctggggtgcagtggcatgatcacagctcactgcagcctcgacctccatggactcgagtgatcctctcacctcagcctcccaagtagctgggactataggcatatactaccacacccagctaatttttaatttttttgtagagatggggtatctcactatgttgctcaggctgatgtcgaactcctgggctcaagtgatcctcccatctcggccttccaaagtgttgggaagctgtctggctcacagtggtgaatacaagttttccaaaatttagtttttgcttgagagctcaaattttttttattggcaacaatatactgtcagttgttttacttgaaaagacaggttgagaaaatgtctggcaaaatctttagcctaaataactaaagtgagtgtgtcagtttttctttcaaagaaaaatggtgtaccatgaaaaatgttcagcccacaactcaaatattcagataagtgcttttcctcaggacggaacattgtacaacagtatgagcgaaagtgttctgttcgttctttctactttgttacacagaatattaaaaagatgtgtactcaagagttgtgatttaataaaatgaatacttactgttttatcaagaacatttggaagtgaaacaggcttttgttttctgcaaattcatgttgatgaaaaatataacaactgcttttttttttcttttttttttttttgagatggagtctccctctgttgcccaggccggagcacgatcttggctcactgcaacctccgcctcccgggttcaagcaattctcgtgctttggccttctgagtagctgggattacagatgtacaccaccacgcctggctaatttttgtctttttagtagagatggccaggctagtcttgaactcctgatttcaagtgatccgcccgcctcagcctcccaaagtgttgggattacaggcgtgagccaccgtgcctggccaatacaacaagttctagtaaattttggtgccactgttttgatttatgctagatatcaagctgtcttcctcactattgcttttgtactataaatgaaaggccaatacaatgaacaagacaaagaatgttatggtctgcttaataatggccatccccacacccgaattcccaaaacctgtaaatatgttacctttcatgttaaaatggactttgtgattaaatatctagagatggagtgattatcctggattatctgggtatctctgatgtaatcacaagggtccttaaaagagggaggcaggaggatcagagttagtggtagcagacatgataatggaaacaagaagtcatgtgagaaaaaggccataatccgaggaatgaaagtggcctttggaagctagaaaaggcgaggaaacagattctcccctgaagcctccaaaaggaacactgccctgctgacacaccttgatcttagacttctggtctccagaactataagaaaataaatttgtgttgttttaagctactaagtttatggcagtgtgttacgataacagtaggaaacggacacggatatcttagtattatcgaaagtgttgtttttaaccttgtggacccctgagaaagatttttggggtctctcgacaattcttgaccacactttgagaattctaagataagctagctgccaaatgcacactgggtacatgaataaggtgacttgttatattgtattaaaaactttaagagtgaagggtttatataaaaagggtaaaatctacatatatgatttcccaattctcttcaaatattatatacacacacagaaaaaacattggaggaaaatacaccaaaataatgtgctttttcttcatgatggaatttggggatttataatttttctttatactttcagtattttccaaattgtcagcaatttggctgcagaattagaaaactgaatttaaacttccaggtcattccgaggtatatttgtatataggatagaacatattaatagtttaaacttgatgtataactaaatattttgtccatatggtaattgggccttctgttgtactattgccctggcccttgtaaatgttaggtttgagcttgtgcctggctgtcatttttccaggtctttatacatggtcctttgtctagaatactagtagtattccaataccaagtagtgctaaagtactacttttactttgcttcttaaattagccctcagtccctttagtaagccttaccttactactcagttaaagttaagggcccctcgtatgtagtaaactgggtgttgcttctattgtgcttgcattcttgactttatctgtatttgtcttacttgtttatagcctgccctcctcctaaattgagcaacacattttttttcagtaaaattatcctagtaatttctgttagtttgtaagtaatttattttcctatgtacatagttctgtttagagctgattcattacattttgattacatagtttaactcttgatgagcattcttatttttttctatttccaagttttgtggggaagggatattcatatataatgggcagccatatatactgtttattttatccttccttcttacaaatgtctaatatattggcatgcatagagtaggagctcgttaagagtttacttctttgtaaaatagtcatctattcaacatattcactgctcatattttataccttttaggagtcttttttcctttttaattattatttttgagacagagtctcactctgtcattcaggctagagtgccctggtgatattttggctcactacaacctctgcctcccaggtggagtgttgaagtgattctcgtgcctcagccttccgagtagctgggactacaggcatgtgccaccatgcccagctaagtttttatacttttttttttcagtagagatgggtttcgctatgttggccaggctggtctcgaattcttgacctcaaatgatctgcccccctcggccttccaaaatgctgggattacaggcgtgagccacagcactcagaccttttaaattatcgaactaatacagttatataaagttttggtttagctggacactaaactggtgggttattcagtagagtagcaggatataagccacttatctatattgttaaactgtattgcataagggcccaccaaaatggtagtgtaatccagaaggaaatagggatagaatagaaagccaggagaaaaccacagaggaaaatggctacctgcctgacattagtcagtgtcatcacacccttttagattttctcatctaaaaaatgaagggaaacatatctattctacctacctgattcagattagttttggaaacaaaagaatacggtagaagaaatgatggaagtgttgctatttaatattatatgtgagagtcctttatgataattttagcctgagtgcccaaagtttaaacttacttatactttctgcagctatcaaacagactacctacatcatgacattcagatagattatcctgggttcataaaaatcttatatggttggctgggcgtggtggctcatgcctgtaatgccaacactttgggaggctgaggtgggtggatggatctcttgatcccaggaattcgagaccagcctgggcaatatggcgaaaccctgtctctacaaaaaatagaaaaattagctggacatggtggtgcttgtctgtggtcctcaatatgcaggaggctgagatgggaagatcacttgagcctggggaggtcaaggctgcagttagccgagatcagccactgcactccagcctgggtgacagagcaagaccccatctcaagaaaaaaaaatcttatatagttaactttaggtcttagtaatgacttggattgcctaggagaaatggcagagtctaggactgagagagtagaaatacaagatgtggccagagtgtcttgtagtaccaggagtgaagaagtactcataaaacaaaggatgggggcacatcagaggaacacaggaacttacctgaagaagctcctaagggtcaaagctggaataatttgagcaacaaaaataatgtagcatgaattataactcaaagtataaaataatcccatatatatgatataaaggatataagttgacataaaggattgaataaatatgaggcaaaagagacaaatctcccatcaaataatttatgtacccattccattctatggaggagaagctcaattcctacctcccttgagggtggactggacttagtgacttacttccaaagaatagagtagggaaaaacctggaaaacactatcttagccaaatagtgaacattaatatcaccagagataaatcatagatatcatgtactcttgatatgtgacaagaagagcatgtcacctttgtgatagtgtttccaaagacccataatcctagtctaatcataagaaaagcaactgatgagcttagactgaatgacattttacaggatacctgactagtcaagatcatgaaaactaggaaagactgaaaaactaagaccgaaggagttcagggagacaagatagctaaatgcaatgtggatcctgtattgggacctggaatagaaagaggacactcatggaaaaggtgctgaaatctatgtaaagtctggagtttacttaatatacaaatgtcaagtttcttagttttgacaaatgtatcatggaaatgtaacgtgttaacaattggggaaactatgaatgagaggtatttgggacatctctgtactatcattgcaactttcataaatctaaaattattccaaaatgaagtttatttttaaaaatggactggagttaacttttaaataataaaagcaaaatgtgcttattgtagaaaatataaatgatgaaaaatataaggtagaaaatgaaaactacccataatcctaccacccagagataactgattatttggatatgtctttttctagacttaattctatgtgtatttcactcagcaaataattattagactcctttgtggaccagacatcttggtaggtgctaatgatagagcagtgaagaagaatgatgtgtccttctcttatggagcttatactctagtgatagagggtactattaaacaatctcacaaaaaaagttacaactgtgatacgataagggctgtaaagaagtatgaatgtcagccaggcacagtggcttatgcctataatcccagcactttgggaagccaagatagatggatcacttaaagccaggagttcgagaccagcccaggcaatgtgactaaaccctgtctctactaaaaatacaaaagttagccaggtgtggtggtgcacacctgtaatcccagctactcgggagactgaggcacgagagtcgcttgaatccaggaggcagaggttgcagtaagctgagatggtgccactgtattccagcctgggtgataaagggagaatatctaaaaaaaaaaaaaaaagtatgaatgtgagaacatataagtggggaaatcaaaattgaatatgtattatttaagatgagaactgaaaaacgaatacaagtcaggcatgtgaaagaaggaagcagggcattggaggtgctaggagcttgtacaggtgcagttgcaggcagagggaaggaacttggagcgttagaggtaaaatgtctggagtgcagagaatgataactagaaagcgagggactgaggctgaagacgtagctaagcaaggtctaaataatacatgtaaagtttttggtacttttccccaagagtggtgggaaaccactgaagatttttgaatcaagggaatcatacgaactttgtaatttaagaagatcattcagaggccatgtgggcaaatggactgttaggtggtgagagtatggaggtaaatataatagttcagaaaagaaattatagtgtctaggactataggtagtgatagagagtagagagattcaaaatagatttaggagtaaaatcagccagatatactgattgttttgatgtagaatgagggagtataaggataaatgttctgtatttctagcacatgcagttggtagtgccatttataaggcagagagtttttaatatataaaacactgccttatggtgcaagagcttaatcatttttaatggttgcataataatcagatacacaaatgtattttcagttcccagaaataaaacatctgttaatgtgtagtgaatatgatgttttgaaaattagtggtgaaaggctgggcgcggtggctcatgcctataatcccagcactttgggaggccgaagcgggcagattgcttgagcccaagagcttgagaccagtctgggcaacatggcaaggccttgtctctacaaaaaatataaaaattagctggggcatggtggtgcacgactgtagtcccagctacttgggaggctgggacgtgaccattactggagcctgggaagttaaggctgcagtgagccatgatcatgccactggactccatccagcctgggtgacagagcgagaccctatctaagagaaaaaaaaaatgagtggtggaattgttgctaaagatagtctgagtgctgataaaacagttgagttggttctttctgtgactaagaataatgaagctctttgtttgatattaactgctggtagaaaacattaataaaacaatccaagaaaggtgttttaggaaacacagtattctcgtatgtagatttataagcacagaaaaatttccaacagtataaagttgtggtatagctccaagaaaagtattcttagttagaagaatttggctttgctacagagtttcaaaggttatgtgtgcgcatattgtcttcagtagatgacaagttgattttagttttattgttttatctggcattttccaataacattggtagtattctaatgagtaagacatttgactctaaagtcaaatttgacaacatatattcttaagccagtttagaaagtatagaatggtggttacattgtaaatctttggcagagtttttgtaagaaattcttaaatgaagttaacatatcactgctaccatttaatgtctgtctgttgggaaaaggtcagagctcttttaaatgctctactctgaattatttttagaaataaacaaataattctaaagttcatctgatatttattctaagcagggtcatgttcttaatacatttgacacttcacattctgttgccaactactttgtaaacatttctacacctgtgtctccagactgcttcagccagagcaacttagttaacctattatacttatatgagggagtaggagactgcccaaatttgtgcgtttatataagagtaaggtaatgcatttagggaagacaaactcatactaggtttatgaaatgctgtaattcaggatgttactaatgaactaggaaagaagttggtattaataataaactggtgccttgataaaattagcctaagatgccagtggaaagtcaatcaagtactggatagatatcatcagaaaggtcattggaaagaaatcagcttaattttataatatacagaaactggtggtttatacctcacttaccaccttaattattgtcattgcattgcaaaaaaaatttttcttcttaaaaaaatttcaaagaaagttaactaaaatgattacctcttcactctacctttctcaccctaatatcatgatgcgacaaattaacttttcttctgtgcatgtagaatattacctatgaactgtccttgggagaattgagaaaattttcaagcttcatgttttgtgttgtggttctggttaagaatttcagttgaaaagggctggaggagttatgtgctaaacctgtaaaatcataagctgaagcaaatatagtcatttcttggtatttgtgagagtttggctccaggagcccctcaggtaccaaaatgcatggattttcaagtcccctatataaaatgacatagtatttgcatatcacctacacacatcctcttatatgctttaaattgtctgtagattacttatgatacctgataaaatgtaaatgtgtaaatagttgtgctactgtattgctcagggaatcatgacaagaagaagaagcctgttcatgttcagtacagaacaaccatccatttttttcctaaatattttcaagccatagttggttgaatccacatatgtggaaaccacagatgtagaatccctggatacagaagattgattatacataaaataataagtctatggacctattttacacagttctgaaatacagaggaaattccttggaaaaaccagcaccttagaacacattgaagtcagtttagatgcttatgaaatttgttacctacaactgattgagactgtaaataagattaaactagaagggtttaggtagggaaaaaaagaagaaatccacattagatattaatagaattagagatacttaggatatgtttttaacttaaagacttttgaattgtgacataacacatcagaaaatgcataaaacgtaattgtgtagtttaattagttattacaaagcaagcatctttgtagcccactgaggttaagacaataaagcataaccatattccagaagcctcctgtgtacgttcctaatcacaacccttcctttccctctgaaggtaaatactattttctctttgtctaatcactttcttgctttactttgtggtttgctcatctaggtatgcatccttaagaatataattcattcaagccagaaatggtgtgttgaaaaaagaagtatataatttaggattgcctgtttttgaaagttaagtaaatggaatcatatagtgtatatgtctttgtttcttggtttcacacaatgtggctttcaagaatcaggcatgttgttgcaggtagtagctgtgtggttgctctaaactattatatatcattttttaaaaaatgaatttactacagtttacctattcattttacttttgatggatcttgaagctcctaacaggttttggtggttactaacaatgctactttgaatattatgcatgtacttgtgtggtacttaggtccttaggtgcacaaattttatttgtcctggatgtgaacttgttgggtcataggtcatgttttccccagtagtgtttcagtatacattcagaccaagaatgtatgagagcttccattgcttcatgttcactaaccacttgatattgtcacacttttaattttgtcagtgtgctagctatgtatggattttgattgtggtttaaatttgcattttctttgtagtcaaagagatgtagcatcttttcatgtctatttggaaatccttttcagagtaccagtttgggtcatttactcatttttctattggagtgtctatcttacagatttgtagaagttctttattttctagacacaaactttttgttggataaatgtgttacagctatcttctatggagtgcatttcactcttctaatggacaaattatgaacaaatattcttagttgtaatgtggtcctatgtgttaatcttttgctttatggccaaggctttttgtgtcttaattttaaaaaacgtccctaccctgatgttatgaagacatttttctatattattttgtaagagctttgccgtttacatttagttgtgtagtcatctgatttgtatatgtgtgtgtgtgtgtatgtgttagagtgtattcatttttttctcatatagatagtgtgttagtctgttttgcattgctgtaaaggaatacttgaggccggacaatttataaagaaaagaggttggctgggtgcggtggctcaagcctgtaatccctgcactttgggaggcccatgtgggtggatcacctgaggtcaagaattagaaaccagcctggccaatatgataaaaccctgtctctactaaaaatacaaaaaattagtcaggcgtggtggtgggcgcctgtaatcccacctactcaggaggctgaggcaggagaatcacttgaacccggagggtggaggttgcagtgagcctagatcatgccaccgcattccaggctgggtgacagagtgagactccgtctcaaaaaaaaaaaaaaaaaaaaaggaaagaaaagaggtcgtgcaggctgtataggaagcatagtgctggcatttgcttctgtctggtgagggcctcaggaagcttccaatcatgatagaagctgaagtggaagcaggcgtgtcacatggtgagagaggcagcatgagagagatgccaggctcctttaaacaaccagctttgttgtgaactaacagagcaagaactcactcattatcatggtgagggcaccaagccattcatgaagggtccacctccatgaaacaaacacccactaagcccacttctaacactggaaatcgcatttcaacatgagatttggaggggacaaaacaaccaaaccatatcagatagccagttgtcccaacatcaattactagaaaacaattttttacccactcttgtacagtgccacctctgatacatatatgaagggctcattatatataggagggcctatttctagactccccattttgtactattggtttttcatcctgataatggttgtgtgtctttttcttctctttttcccaattcttctccgtctcctttcctttctcctattccctcctctccttccctcctcctttcccttcttcctctctcttgttctcctttctctccccttgccctcccccatcttaatctgtgtcactgtagatttatcaatagttagtttttccaatgaattggtttgccttttttgttcttttctattatgtatttcttttctgtttcattaatttctgatcttctactttctttgagtttattttgatgagttttttttctaatttcttgaactggatggttagctcctcagttaacttgcctttaagtgcatttaaagctataaattttttttcagatactgttttatttctatgccatatgccttttttattatcactatttaaaaatcatttttaacgtttataatgagtctactttgggctataggttatttagaagttcagtttataatttccaacacatgaggaatttctggctgtttttaattatttataacattattgcatcgcggtccgggaatatgcattatgtaattacagtgtgttgaaattttttgcaacttgcattgtggcccagaaaaaaagtcaacttttgtaaatgttccatgtatgctataagaatacataatgtgaagttttcagttatggtgttctctccatgtccattaggtaaagtttgttaatctatgaaaatactctgtttctttactgattattctccttgtttgtttctattaagtattttaaaaattttcactgtatttgcacatttatctactgcttcttgtcattctgtcaatttttgctttatatactttgatcttatgttattaggttatatcttcctggtgaattgaaccacttttattttttaaataactctatttctaattatagttttttatcttacaatctactttgatattaatataactcccaatattctttggattagagtttgcatattatactgtttttatcctctttactttcagtctttctgcatctgtttgttttgttgaaactcttgaactgtatagttgaactttcaaatccaattaggtagcatttattttctaattggaacatttagtttggttccacttaaggtaaatagtggcatatttggatttaaatatttctaaaatttagaactcttaaaatctttttttgcttagtctttatattagcttatgttcatgcctgaatatttgagaaactccttcaaaaggaattgtttaggcattaaaacaggtttgccggttttggttctgattttgaaaaattgatcatcgtgtgatgttttttgtttttgtttctaagatggggtcttgctctattgcccaggccaaagtgcagtagtgcaatcatgactcattgcagccttgacctccagggcccaagtgatcctcctacttcagcctcctgcgtagctaggaccgcaggcatgtgccactatgtccagctcatttttataaattttttgtagagacgggaatctgggaatctccctatgttacccagtctggtcttgaactcctggcttcaagtgatcctcctgcctcagcctccagagtgcagggattataggcatgagccgccatgcctgggccaattgtgtgatgtctgtgaaagcaaactcttcatatttttattcctgtgatatgttatttgggtaaccggatagctatattggaaactaaaacttcttatgtttatgaggtatgaatattataaaaccattttgttttttccatttattttctggcttgtcagttttaagaatttccacctcttctttctttagggcttcaataactttacaactaattgtgtagtttattgattgtcccccagaaaagctttgctgtatcttttttttttttctctgatgcattttgattcggagaatgactgacaatgcaagttaaggtttagtgccatatagtgtgtccaaatgtaaacttaaagcagcctgtattagtcccttctcatgatgctataaagaaatacgtgagactgggtaatttataaagaaaagagatgtaattggctcacagttctgcacgctgtacgcgaagcatagcgtcttctggggaggcctcaggaaacttacattcatggcggaagatgaaggagaagctagcatgtcttacatggccagagcaaaagcaaggagggcagtgagggaggtgctacacacttttaaagaaccagatctcatgagtactctataatgagatagcaccaagtggatggtgctaaacctttcatgtaggctccacaccatgatccagttacctccctccaggccccgcctccaacattggggattacaatgcaacatgagatttgggtgaggatacagatccaaaccatattacaaccatactgatggattgtaaactacagtttttaacctgcttctattaattagaggggtaaaggttgtaattttttattaatgtttatctcatgtaagtggttttatttataagcattcttttaaaaatctttttggcttggtgcagtggacagtgttgggtgggcctggacaacgttgtaagacctatctctacaaaaaaagaaattaaaaaattagccaggcatggtggcacacacgtgtgtattccctgctattggggaggctgaggtgagaggatcacttgagctagggggtcgaagcttcagtgagctatgatcatgccactgtactacagcctggacgttggagtgagaccctgtctctaaaataataaatacaaataaaaaatcttttcattatggaagaaattttaaaacatggaaacatatggagaagaatattgtgtaccttttcatcctggtcacttactttaattaattatcaattcatagccaattttgtttcatttctactccctcaattatgttgtaatctgaaacattgtgtcatttatataggtaggtagatatacatgtatattgtgtatttctaaaagattaagattcttttaaaggtcattattttaaaatatgaataattccttaaaatcaaatatcttgtgtttcccatttccccaattgtttcttaaaaaattgtattgctgtatcttttaagtctttttaaaaaaaattctgtaggtttccctctctccctttttccttactaaattgtatttgttgaagaaaacaggtcatttgtttcctagtttggttttttcctgattacatttttgagctataatttaacatgtttctctgctcctgtattttctataagttggtagatttaaaggcaaaaaattgtttaaaatttatttttattgttttaaaatttaagtacttctaatattgtagatttctcagatcattactgttacaaggggcggcttaaaggtagaactcttaaaatattattatcatctattctgccttcctggtttgtagatacagagacatcccagagaggttgtgatttatccagatttccacatcaagttgagattacagtggagggtgcgttcgaaagtaaaaataacttctccttttgaattttgatggcttcatgtgtgctacttgtgattttggttctttagaattcatcctgagcatttttccagagctatgcctaggaattcttgaatttgtcttctgctctctctctatctgggctccaccctgactgtaattcagtttgttaatatggtaataaaaagtctctatcaaagtcctcttatgtgtcaaagtcctcttttgccacatcttccagtctaccttgtgcttttctaaattgtgattggacttaacctgtgtactgattcttttactttaagaaagtggcagttgtggaccccataaacacaagagatgtgtttacttctgaagttttaaagatttttaggtttattattacaaaagtaatatatttgtttaaacagtgtggaattatataaacactgaatgtactcctcaacctctctaccttatgtctcagtgataacaattgctaagggcttgatgtgttttattctaaacttaattctatacaaatataattatatagatatatattatatatacacacaattgtttatctttaaaaataattcaaatatggctacaaaacttttacaatatgaagcattgtcagtatttattttaccgggaggatttcccccatcagtgagtgctgactgtcattttcattctttatgatcaagttgtagatcaggaaaaacaagttaagagagtgcctacaaataccgggaaaacttgtggatagattttcattttttatgtaaagacatataagaacatgaatggtataaaaacaaaatcctttataaatgccatacaattatatatttagaaaaattatatggtggtaaaacatataaaagaaccacacactcccaaatttacattgagctaatttagtacagttagcctttgtcaaagctttccttgtttaaaaaaactattggctcagtgtgcaggaaggagcataggagaaaaaattgccaagaatatttgaaaaatacagaaaataaagaaaaaaatcacctactatcctatcaaaaattttaatagctagaatcaggataagatagaatattcctgtggcagtaattctagtctatattcctttcctggaaccctgtctcccaaatttcaggtgagattttataagaagctctgtttatctgagatttaaaatataaaaacttgatttaacctatacagttttttaaaaagaccctaaataagtaaaatttagtactccacaaattgaagagaatttctctcttctctttactgccctctgagttttctctttccttctctcacctccaattttcatgtaaacactttcagttcgagtggaccttagagattgtctcattcaatactttaggaaaacaaattttatagaacccttgagttctgtggaattgcttctaatgaacaacaccttttgttgttgttgttgtttagtgacactgtgtaacaggcatttcaggaggagaatctcccagtctagaggaatcctctcagaggtagctataaaatattgaactctgatcttcaataagcattgtgcggtttttgtttttgtttttaatgacagttttaaacaagaaagttgctttatttctgaacttcataaaaatttctattaaagagacaatttctgaattttataacaatttctagaacagttgagtacctcactttgagacacatttttgctaaaagttaaaaacacaaaacccttatgagataaaataggaagctagtagagataggaaagccctctgcttagtaaacctcttttttgcgtagtttagacacatacaatagtaaagttacttagtacgttgatagttttctttctcctcaaaagctacaatgtcttactagctagttccttcaagaaaggaaacaagaagccgctggaggagattggtgagtgggataaaacactattcaactcttcagttattcggtttttaaatcctcaatgaaaggctgctgtattatagagtattttttttttatttttaatagacttagaaccaagtttcttgagaaacctttggcatattgtagtttttttatggctatgactcacatgacattactgtataaaactagtacattctctcgtaaaaccacacaaacttactagagtgctgctctcatttttctacattagaaatgaaaaagggcattgtctgcattcaaaatttcctttttacatctctgtattactttttcccctttatatttatcttaaaaccaaaagaaataatgtttctattgttttactgtagttaccactgatgctaccgaagctgtattgtgagtgtttcaaaattctcaaaccagttttgtgtgttgtacttggagcttagtcattgtcatacgtagcaggacctgattaagaaggctgtgccgcctctaagccttgctagattgtagccactagcaaccaggctgcaataatttccctttgatgacatcatccactgtggaagaacccagttgcttcagcgagtcgaactacagttttaacctcatcaaatatggcatctcccttgcttgctgcagcagggatggaagaaatgtcactttctttttaagctagcaagctttttctttttctttttcttcttctatttaaaaattctaatcatggatgcttcttccgacccttatttgccttatgacgggggaggagacagtattcccctgagggaattacataaaagaggtaatactatccccttgctgtgaattctctgttggtatgttttgcatgcggctgggcggtcctctagcttaaactggttctcgtttgtcctttaaatactgcagtacgttgtttagttgccctgggttgttagtaaggggaaaatgcaaccttctgaatggttgtgtagccatccctgattgttttctctgtgcagattagtactgcttcagatcacgtcgggctccgactccatcttctgcatgaaaatcttctttctaactctgaaaatgaattaatctgcttttacagccaactaaagtcgtgttggttggcatctaaaaagtaatgtttttcttccttcagaaaacttacatttcctttaatttacacagagaaatcaggtgcctatgtaccattatattttagctgctgccaattaccatgtagattttacaccacaaagtaaatttatagcaaaagctttacctacattttagaacattttaaaatgatagtaaagatgaataatttctatattaatactttttatttaatatgtatttcggctgagtaacatactacattgtcttccacaggtatcttgtgaaatttgatatgataaaacacatttgactaaatgtcagaaaaaataatattggtttgtgaaaagcagaagagcacccagcatgcctgtaaatcttttggcaggcacttcctcagtctccttaaaattaattgcatgttaattactaccctttttttcatttttgtttaattgcttattcgaaaaacagactggtcgacatttgttgtcctagaaaaaaattgaacttcaagaaaaatctcttagcttatgtgacttcatttttgagccacattagtttgaattactgcatgatattataaactcaccttatgatttaacccaaacttttatttgtaagtatataaggaagtaataatgtttttctaatataattagcctgctttatttaaaatatactttgtgttctgataacactttttttttagtattaagttccactataatttaaacattataatgtattcaacaaatgtctgttggttgcattgtgtctgctacacactattttagggtctgaacagttgtagcattatttatcttgcagtattctgtagttagtaaaaacttgctttttacattttgagaaaagctgtgtaaggatcatgttacatacattgtgctttctcttacagagttaccttcttaataaaattttgatatatgtgtatatgtatatgttagaacatttggaagaaatatctaaaagcataaagaagaaaataatttcttgtaatcacaccacccagagctttttaaattttttttcttaatgttacgatcataaattcttctatttcctatgttctgattatcagttttctggtaaggagttctttaaacaggaagcaaggtgaatgaatagtgactgttcaaatgtcacattatttgctaatcagtaattaaactgtaaaacaagacagactgtattttcctcatgctattacaacatttggttgttaatgatgatagatcagaatacctgggcttcagaaatttaaattccttttgtgaagcttaacagtctttgacagaacttacttatggactgtcttagtgtaaaatatgcaaataataagaaataagtcaaaacttatgtgagagtaggcatggttactgatattacctaaacgtaagctttttatttctattatactttcataaataatcctttaagaatcttgcttaggatctaaatcagtcccactcttggcagctcaaataggttctttatcccttgatgagacttattctattaatataagtcattgttatttgaaagtaacattgtgtatgtgtagtagagataagtcagttattaggctttcgtgactgtactgtattacctcaaacatactgtagtatcctagtgtctatgcgtaagatgttattttttgtccataatttatgacctgttgtagccatgggtcaacacaatggaattgatggagacaggcagctaacaaatcgaaaaaactgaatcagcttccctgtgaggaagaacaaaactataatgattaaaattgatcttcagcctgatagtgaagaggcagataaagtataaaattgtgaaggatatcaataaagtaaacatggatctgtttagtaaatccctgagtgctatagccaaggattacctttgttgagtaaattgaatttaatactacttttcaaggcgagatggtaaatggtgaagcttcctatttaagtaaataatgtcaagtctggaagtataagtagattcaaattagaattagtttgatatactattgatagattagaaattaagatgacatttcagaaatagccatctttaggggtagatttcctatatagaaacaatcaagctctctcaaaatgtctcttccttttttatcaggaaaaaagacttggcttatctggactgttagttttacactttttcttcttaatttgttcaagatgtttaagtagttttagaggtcaaatttctttcttctaccaaccctttataatggatttgatcttttgggcctgagcctccatttactccatgaggggcctttaacaattatttaaatatttaattgtttcattcagagtgagcatatatgtgtgtgtgtgtgtgtgtgtgtgtatatatatgtgtgtgtgtgcgtatatgtgtatatatatatatacatatacacacacatatggcactcctaggtgctgtggagaattataaaaatagtaatattaataatagttaatatttattagaatttcctgttagctggatactgtcctaagtgggtttttttgttgttgttgttgttgttgttgttgttgttttcttaagagagaggtatcactttttcacccaggctggagtgcagtggagtgattatagcaaatgcagccttgaactactgggcttagatcctccgtctcaccctccttggtacctgggactgcaggcttgcaacaccttgcctggctaatttaaaaaacaaaattttttttttttttagggagagtctcactatgttgtccaggctggtctccaactcctgggctcaagcaaccctcctgccttggcctcccaagtagctgagattacaggtgcgagccactgtgcctggcttgttctaagtgctttatgtgtatgaaattatttaaatcctcatcacaagtttatgaagtaggtactgttataatccccattttctagttgacaagactgaggtaaggaattgttaaggaaaagtcagaattccatccagatatttggctcatactttaatcatgaggctaaactgcttctctctacacgtatcttcatagtaacttgtgttttaagtctggtagaagcataagaagtttaaacacagacagaatcctgtggaagttagtaaatttctagtgaacgatagaaatgatagaaatctcttcttcccccaaagtcccaagaacagattagtctgcttttgacaagtgttatcaaagtagactgttctcacatacacaggggactcaatagggcattcctggtggatataataaaatgagtaaatgcgataacaggaggaaatgcctagtgtgttgctcttggattagttttgatacaacaaaggcagctttgttgtgagtcagtagagagggtagtgtagaaaggtggaagttggaagagtggcagatcctagaggactaatgatgggcttaaaccacaaaaagtgtcgctttgccattgaaataaaagtttggggtcttattttttcaagtttctccctgaaattatttcttgacattcattagctcagcagtgtatctaaataaagcttttttgggtttctattataatagaggtttgttcctttttcttccctttgaaaagtatcattttttgcacattatttgaaaatccaggtgttatatgatattcttattgccagagggacattctgcaggctctttgtaaaatgattttaggattcagatacttattatatttttattggccctaatattttatccaactagaaaattaaacctcttcttaaaaattaatccatctaagtgtctgtaaattaaaggaacaactaaagattctttatttggtgtcagaaactccttgtttctacaacagtagtataaaacaaagcctgtttttaaatgtacttttcccacagtatctgaatttcaaatcttcaataaaatctggttcatattactacctctagcttgattttctaaaaatagctgacactttagtatggttaattttatgccatctcatggcttgtcagaaatgctttgtatcaagatttccgagtgtgaacagatttcctgccgcattgattaagtttgtaattttggctattttcccagcatcgaggtttctgctttgcgtttatgcaggagactggtagtttaaattgaactttaaggttttgtttcttgtttttaagttaacatatgtttaatttctagtttctttgtagccctttgcaactttaattaggtcataaaatggatttactctagtttctctaacaaattttataaatttatgaaatatgaaatttagcaaattttataaacctttttattcatgtattgtacagctcatcatatttgcagacataataattgaatgtggaacttgtttccaattacacagatgtcttaatatccaccttatcatctctaactaaggatgtggctttttattttgaggtggcaacagaacagaaaagaaaacagtgaattgagtaatgggcttagtattgctgctgcctggttgtgtatctttggtaaacttctttgagatttggcattaacttgcaagtctttgcagtttagacagttaaatatgactgaatggctgaacaaattttaatagcgtatgcttcttttttgctatttatttacccagtagacatttaattgaccacctgctaaatgtgaggcactattcttgccattacctttttaatctttgatttggagtctgctaacattctggaacttccactatcaacttagaacgtttactttcccatcccttaccaggatggccatttcttatcagtagggtcacagagagagaaaaaaaaaaaccatctggggctagacttcctgctcttaacatacagaagcaaataggttgtgaaggaatacatagtattttggatttctgcctcttccttccataatttttttaaaaaggttcatatgttttatgtgtgtcttatgtaacagtaatctgcattatgaacttaaatgacgaggatcaccatttcacatctttggagattgatcacagaggtaataagtaactctttttaaataactatatgcatcatttttcatgtaaaactattatttggataaacccctttgagaaaaggcttaggctcctgccagtgtcactgtgatatttactaataagctcagtttaaggcgcagcaattaaggttgtgttgtttttttttttttaagttcagttcagcaaatatatgtggaaagcttgtgggtaaaattatatttgtatttttgggaaagcagacaattttattaatgcctatatttttctagttcagtgtttgtcaaacttcaagttttaacatgttgatcatgaaaccagttgacttgtgaccagtattttaaaaggaaagattaaaaaaacaaaataaaatatcagtatataccaagtagtaagagtaagcattgtttactaaactttggttttatttaagtacatatctatatactatgtcagtgagaaacatttctccacttcatgtttgaaaaacatttcaaaagctaagaaaaagtttgaaaacctgtttgtaagtacacctggggtaaaggtacaccctgtggcataagatgtcgggaacaactgagggtaagaatggggatgcattactatcgtaaacttctgctaaagcataaggatgtgagtgctgggagcaaagcagtgctcaccacttctgcaattttctattgcagcattttaaataatatgggaaaaagtggactgcaaccaaaggcaaagagggatggtgatggtgaagggtaagattgtatttattgtccaaaggctaagtgcatatacatatgtgtttgggagaaggcatcacgtaatagttcttaacctactctgagagaaggttgtccacatttcttaaagtatacatgtaaaccaacaatgaaattattttagtgacttgagaatcaaagtgctagagtttgaatccctgttctactacttgctagcggtgtgaccttgggcctgtttaactcttgacaccttgttttccaaatttataaagtggagataataatatctgtcacattgtgttgttgtgaggattatatgaactaatatatgtaatgtcctgagaacaatgtctggtacacattaagttaattaaaattagctgttcttactgttattattagacatgagctagataacagtggcctctacatgggaaagattattttaattctgatgtagttcagtttatctattttttttatttttgtcccttttgcattgatgtcatatctaaaaaacctgcctaactcaggatcacaaaaatttactcctgtattttataattttagctctttagatctaggatccatttttagctaatttttatatatggtgtgaggtaggggtacggtttcattcttttgcacgtgaatagccagttgtcccagcatcatttattcaaaagactattctttcctcactagaaaaaatatttctttaaagaataatgaatccttttttttttctttttaaccgctgttactcagttggaaaaagaataatgaataattttaagtaattttcctacaggtaaatttaagtctttatgtttagattacacatattaggaaataatggatttgtattccataggtatgcttgatctttataaagttccctgtctctggaaaaactaaaataaggcaaaacaatcttcttagtagagttatttttacaagaaagttgcaagccagttttagttcatcgattggataatttttcctgcttgctggaggtatttcagtattggtaatacctgaactatgagatgcatgaatgatgcattttaggaatttgtttctgtgtccataccaggcataatgaattaagttatctgttaaaaatacaggatttttgctcaatatacagttgtagaagaactcattgtccaaatttttaagacttttttttctttttttttttgagatggatctcgctctgtcgcccaggttggagtgcagtggcacaacctccactcactgcaacctccacctccagggttcaagtgattctgctgcctcagcttcccgagtagctgggactacaggcatatgccactatgcccgcctgattttttttagtagagatggggtttcaccatattggccaggctgctcttgaactcctgacctcgtgatccacctgcctcagcctcccaaagttctgagattacaggtgtgagccaccgcgcccggccagacatttttttttttttttttttttttgctgtctttgtcatattgttagtcttttggttaagcgatattataacttagtcatatgagtaatataatgcaacatgctgaattgtgtgtgtgagagggggttgttttttgtttgttatttgttttttaaatagagatgagatctcactgtgtttcccaggctcccttgaactcctgggctcagatgatatagcctcctgccacagcgtcctgattagctgggactacaggtgtgcaccactacacgtggctttcctgatgaaattttaaatacccaaatatttgagcagaaataatagcttgtgtttattgtttttctactatctgtcaagtatagtattaaatgttttacataatttgtctccagtccacatacaatactctagtagaagtgggtaacaaaaccaaggtactcaaagaggttaataagtaacttgcgctggatcacagaactaacgggaggcagggctggaatttgactctaggtctttctgacctcaaagtgcagtaaagtcatggaatttctctactaggccacctggaagaaaagtgatcttttttccagtcttttttgttactgtttttcagccaggagatagtagagttaggtagtagaatagtagtcactggcatccggtagtcagccctccaaaaaagtttttgatttttttttttttttgtcttaaacttggaagctactaactttcaggtcatactttcttatcatccaagagctggatatttaggtagcagaaactatggaattatcctaagtcctcttgaagcttcagctgttaaaattaattggttctgattaacactgtgctcaagatttacatttctaggagccacagtttgattggtctaacttggatctatgtgttttctttagctggggaggagaaggtatcttgattgataccttcaccaggactgcatgcagtgagggacagaagtttccttaaaataattgggttctgttataggaagaaggggaaggagataccaagtgggcaaaacaatcaggttctattacataaataataaacctaatgtgacgataataaatggataatatgattattttaagtttggaaatatacctggttattagtattggatatctggtagtggggttggagaaaaagtcgagaataagaaaagacttaaaatcgtaaaaattaactggaaaagaggatggctgagcagatacatatatgttagataatgttcataatggcaaaccaacctgaagatttgtttaaattgtagtatgtagccaggtgtggtggtgcttgcctgcagtcccaactacttgggaggctgaggcaggatgattgcttgagcctaggtttgaggctacagtgagctatgtttccaccactgctttccagcctaggtggcagagcaagaccccatctctaaaaaaataaagtaaaatgaataaattataatatgttatgacaaatatagttatctgaagtcacagaaaatgtgcatgtgcatttaatgatgtgaaataatttttaggaagtatgaataaaaaaatcaacttttaagtgtggctagtatgatcttacctgtatctcacttatagaaaatataaaaggctgaagccagtcaccagtttaatagttctaacctcttgtttacttgattcccttttttctcctccccagcaatcctcatatagttaggtaaagttggttcttcatcaggcttgttgcagaaacccctaagcctttttacttaaagctttttgaaacccagaaacccatcttttgaattcaaaagttttgactgttattagtctttttgtatgtttgttggccgcataaatgtctcctttttatgaacagagaagtgtctgttaatatactttgcccactttttgatggggttgtttgtttttttcttgtacatttgtttaagttccttgtagattctggatattagacctatgtcagatggatagattgcaaaagttttctcccattctgtaggttgcttgttcattctgatgatagtttcttttactgtgcagaagctctttagtttaattagatcctatttgtctgttttggcttttgtcgccattgcttttggtgtttcagtcatgaagtctttgccagtgcctatgtcctgaatggtattgcctaggttttcatggttttgggttttacatttaagcctcaaatcgatcttgagttaatttttgtataaggtgtaaggaaggggtccagttccagttttctgcatatggatagccagttttcccagcaccatttattaatattaaatagggaatcctttccccattacttgtttttgtcaagtttgctgaagatcagatgattgtagatgtgtggtgttatttctgaggtctttgttctgttccgttggtctgtatatgtgttttggtaccagtactatgctgttttggttactgagccttgtagtatagtttgaagtcaggtagtatgatgcctccagctttgttatttttgcttaggattgtcttggccatacgggctcttttttggttccatatgaaatttaaagtaggtttttctaattttgtgaggaaagtcaatggtagcttgatgggaatagcgttgaatctataaattacttcgggcagtatggccattttcatgatattgattcttcctatccatgagcatggaatgtttttccatttgtttgtgtcgtttcttatttccttgggcagtggtttgtagttctccttgaacaggtccttcacgtctcttttaagttgtactcatcatcactgatcattagagaaatgaaaatcaaaaccacaatgagatgtcatctcatgccagtcaaatggtgattattataaaaagtcaaaaaagaatagatgtgggtaaggctgtggagaaataggaatgcttttacactgttggtgggagtgtaaattagttcaaccattgtggaagacagtatggcgattcctcaaggatctagaaccagaaataccatttgacccagcagtcccattactgggtgtatacccaaaggattataaatcattctgctataaagacacatgcacacgtatgtttattatagcactatttacaatagcaaagacttgaaaccaacccaaaaagccatcaatggtagactggataaagaaaatgtggcacatatataccatggaatactatgcagccataaaaaagaatgagatcgtgtcctttgcagggacatggatgaagctggaagccatcattctcagcaaactaacacagaaatagaaagccaaacactgcatgttctcacttataagtgggagttgaacaatgagagcacatggacacagggaggggaacatcacacaccgaggcctgttggagggtgggggacaaggggagggagagcattaggacaaatacataatgcatttggggtttaaaacctaaacgatgggttggtaagtgcagcaaaccaccatggcacatgtgcacctatgtaacaaacctgcacattctgaacatgtatcccagaacttaaatttaaaaaaaaagaatttttctcctctgtgggtttcagaagcctacatttgaaactgggatactgtaatatcgaatcgtgttctccatgctctgctgtgtatttcttttcctatggcaatggatgtctctgactgaattggtgtggggaaggtgtgtggaggggtcaagaaaatagcatggactaaggaacttgcttagtctttcctggaggtgttccactacagctctactactgtcttcacaggtaagtgagaactgcatatgctttgagaaatggctgatccaaggcaaatcctgtcattttaggttaataaaatctaactgtgagcacagtggctcacgcctgtaatcccgacactttgggaggccgaggcgggcagatcacgaggtcaggagattgagaccatcctggctaacaccgtgaaaccccgtctctactaaaaataaaaaaaaattagccgggcgtggtggtgggcgcctgtagtcccagctactcgggaggctgaggcaggagaatggcctgaacccgggaggcagagcttgcagtgagccgagatcgcgccactgcactccagcctgggtgacagagcgagtctccatctcaaaataaatgatagatagatagatagatagatagatagatagatagataaaatgaggatctgggactacagacgtgcaccaccacacccagataatttttgtatttttaatgaagtcggggattcaccatgttagccagtttagtctcaaacccctggtctcaagtgagctgcctgcctcagcctcccgaagtgctgggattacaggtgtgagtcaccacgcccagcctttgatatattattataggaaaaaagaggagatgtactttatgtagaagagaactttaatttatgctgtgacggtacctaaaagatacatcctttattcatgcgtaagatgaaatcgagaggtgaaattggatatactgttgcttttaaaaaattttaacatatatgtaattttttgtacttatctcattttagcctatataagttatatatattttgtttgtttgtttgtttgttttgtttgagatggagtcttgctctgtcacccaggctagagtgcagtggtgcaatctcggctcactgcaaccttcgcctcctgcattcaagcgattctcctgcctcagcctcctgaatagctgggattacaggcacctgccaccgcgcccagctaattttttttatttttagtagagacagggtttcaccatcttggccaggctggtcttgaactcctgaccttgtgatccatgtgccttagcctcccaaagtgctgggattacaagcgggagccaccgcgcccggctgtaagttatatcttacacaaatctaggtttcattcagagaattatatgcaaagaaacagtgcaataggattattttaaagctattgttattgttagaaaacataatacctttaaaattccttttcacattagaaatatagtggcttctccccagtttaggatagaaattttccttttcttctccttctttatactattcagatttgcatgtttgacagaacaaattataagagaaaatatttgaaatgtcacatactaaagtaaatgtttgaatgtttgaaaattttctggttttcagagattttgaattgctgaatcgttgtgtaaattaagatgttgagtagtttccacagagtaattatttgaaagtcactgaaagcaagacacatgcctaatgtaaatgtttattgcactactgtacctttttctacctcataaaaatgagaatagcagtctgtacttttccacttcgtcattcgtaagtctttgcagaaattcatattttgtttgcttattatcttcacgctgtaaatagcttgaaaattctttaagtggggctagcgatgtattatggatacatgttaagtggtatagaaatttcacttttttttttttgcataaagagtaacaagaccagtagtccatatttcttcagctctacccagagaagggcaatgtaggagggaaaatgaagtttgcaaaatatttcatagtaggctttttcttaaagtaacttcagacttacagaagtttaaaaatagtacaaagaatcccatatacctgtcaccccaattcctgaaatattaatattttaccacatttgttcattatgtctgtattctccaagtacgatatatgccattatatgtaatatgtagcattttatatagacatagggcatgtatgcactatatatttttttctgagccacataaagagtaaaacgcagacatgacgtgcttttactcctaaatacttcagtgtgtgtattccctcaagaaagggcattttcttctgtatagctaccgtacacttctacacttttcaaaatcagaacatttacattgataccatactatgacatgatctgcagaccattttccaatatgccagttgtcccactgtgtcctttagtacaaaagaaaaaagttttttttcctggtctaggagctaatcctggagcacatgttacatcctgttgttttaatctagaaccgttcctcagttctttatctttcataaccttgacatttttggagagtacaatccatatattttgcagaatttcccttagtttgggtgtgtctggtttttccttataagattcattttatgcatttctggccagagtaccacagaagtactgtatatcttaccagaaagcctaagtggcatttgcattttctaaatgatcaattttaatattatatggaaagcagagtcagagattctcacatatgtcaagatattataagtattcctgttatatttattctccaattgctttttctcaagaaaatttgtggcctttcagctagcttttcaaagtggaagttactacataacattaggatgggagggtggggaagagctttattaaagctttaagattgagcttttgagtatgtgttgtatgtaaatgaaagtgggcattgatgcagggattgggcctttaaacctttggccaagaatggtatcaattattattattattattttttggagtacttctgctaaaacactgaaatcagtgtgccactctccttttagaagttttacacctttccaaggtacacttttttttttggagacgagttttgctctgtcgcccaggctggagtgcattggcgcaatcacagcccacttcagcctctgtttcccagactccagcagtccttccacttcagcctcccgagtagctgggattacaggtgcacaccaccatgcccagctagtttttgtagagatggggttttgccatgttgcccaggctggtctccaactcctgcgctcaatctatccgtcctcctcagcctgccaaagtactgggattacaggcgtgggccaccactcccggcttccaaggcaggcatttaaatgtaataaatagggagataagcaagaaccctgttggacctggtagaagcaaacatttattagtactattacgttgtttaaaatattagcgccttctatattcatgtcctcccagaattatcaaaaaacctactctatagtttatttggcttatatctcaggagtaataaaattagttaatagtattggcatcgtggttctttgtgtattcctcccttatcccaccccaagttgatttcacatgatctcttgatctagtctaagaatgtttatagtgattacgagaagttcagattctggctttaacatatataattgttttttaatctgtaaaccaaagagaatgagtttgtttaaactagaaagatggcaagagtagtctgggaattttgttccattccttaaaagtcctataataaaataaacatatcttgtgttttatttttacaatttttttaaacattagtacagagtgccacttcttatattctatatcaaataatgagctacattttcaataataacctctgagtaatttttggcattaaaatctgcattacaaaataatttgaggatataatttataatcacttatgctaaaatcacctatttgaaattatgtatgaggttttcaaagtttatagtgctttggaaaaaatttaaatgtttctttgtttatgtatctttattataagctgtagcatatatcatgtagttgtcaaggatgctgatagatacttaatatttaaaggagacttgtctaaagttagctgtccaggactagaatctgggccttttggtaacagttcattgctctatttacttaaatgatgattggattcgttagaatttctctattttcatagctgtctctatggttctatgaaaatactgtgtgtgtgcttatacatatatgtatacctgtaagtacaaagtagaaaatgaaagttcattttctgcttttgacaattgtaatccccagagataaccgttattaatatgttgtctcatgtttggtcatactgttttctctgtattctgtgtattactgtataaattttacacagtaatttgcatattaaaaatgctggtctacacctggcccttttttaaaaactgcaatttattatggccaattttttataccagtatatattgatcaaccttattctttttaactgctgcatttcattcattaccaatagatgagacatttccataggtttgaatttttcagtattacagataatggttcaattaaatatttaagcttttgtgcacttgtagaattaattcctagacatagaacccttatattttgataggtatttccaaatttcttcccaaaatgtttgtatctctttacttccactctcaggtctaataattttcacttggattatcatatttcttacccagcctgttttttacactctaaactctttttcttttctttttttttttgagacagcatcttgctcttggcccggttgaaatgcagtggcacgacgaccaacctgggctcaagcaattctctcaacttagcctactgagtagctgggactacagacacatatcaccatgcccagcatttttttttttttttttttgtatttttagtagagatgaggttttgccatgttgcccaagctggtctcaaattcctgagctcaagcaatccacccatctcagcctcccaaaatgctgggattacaagcgtgagccactgcacctggcccaaaagctctttttctaatagcaatataaattgtcttttacagactatactcatatatgtttcttctttcagaaataggtgttaagtgtatctaacatggaatgtatagctataattctcattgtgaaaccatagcctaatttatttcatattacaatttaaaattcatattttttaggaagttttcttagattaatccgcctagttccaggtgctacagtcccaagatttctttctttttaacaaattaaatataggtaacatgactagaattgtagtcaaagaatattggaaccttggaacttcagtatttgaactttattttgaaatataatttgttatattataaaaatattataatatattgcacctggaagttaggggcagttttttttaattctctttgtatctgctacactgtaaagtgctatttatgtaaaaaattcttaatagaagtcttcagttgtaaagtctgctgtacagactttagatcagggattggcaaactatgagccatgtgccaaatcctgcccttcacctgttttgtaaataaagttttatcagaacacattcagactcattcatgaacatattgtctatgatttattttctgctactatggcagaattgagttgttgcaactgtgtggcatccaaagcctaaaatatttactctctggctctttgccaacccgttttagattatgagcactttggcattattatgtttttgttttctttctatagcacacagtaagatgttctgcccacattgtgcataatttatgggtttattcaaggatttatgcaagtgtagctgcaagaaaaaaacctagaagtgaacttgctaggttgaagagcatctgtgtatgttaaattttgttagctttcgccttcccaaagggattattccatttcatacttaaactactaattttgtgataggacttctttctccatagctttgctaaattaatgcattcacacacttcatctttactaatctgatagagggaaatgatattgtggatttgatttccatttctttttatgtgttagcttgagcttattttcatatttaaaagccaattgtatttctttttcttgagctatcttttaatgtccttcctgatacatttctgaagtctgtgatactcatataagatatatggtgaacatgtgtcaaagatttatttgactctaatgagggaacccgcctgatgacaaggctgattgagaagaggatgtgtgagatgaagtgtatatcatcagtgaaagaaagcaaattcttacagggcaaaaacaaaaccacaactctaagggttattgtttctactggacagaattcatttgcattttaccagataaaaattactattttcaatttatcttttacaaatcattttctaattttacagagtctattccctaatcagtagtaaatagtcttcaaaattctccgcagcgtcaggtgactattatgcaggctaattgttgacactcgggcttgactttaagagaacatgccataatcttttggccttacttccaagttttggataatttttcttaacacatttttctctaattgcaatgatttcaagtgatattatttcttttttttaaatttttttactatttattgatcactcttgggtgtttctcggagagggggatttggcagggtcataggacaatagtggagggaaggtcagcagataaacatgtgaacaaaggtctctggttttcctaggcagaggaccctgcggccttccacagtgtttgtgtccctgggtacttgagattagggagtggtgatgactcttaatgagcatgctgccttcaagcatctgtttaacaaagcacatcttgcaccgcccttaatccctttaaccctgagttgacatagcacatgtttcagagagcagggggttgggggtaaggttatggattaacagcatcccaaggcagaagaatttttcttagtacagaacaaaatggagtctcctgtgtctacttctttctacacagacacagtaacaatctgatctctcttttccccatatttccccttttctatttgacaaaactgccatcctcaccatggcccgttctcaatgagctgttgggtacacctcccagacagggtggcggccaggcagaggggctcctcacttcccacactgggcggccgggcggaggcgccccccacctcccagacggggcggctgccgggcgggggcgccccccacctcccagactgggtggccgggcggagacgctcctcacttcccagatggggcggctgccgggcggaggggctcctcacttctcagatggggtcgcggctgggcagaggtgctcctcacctcccagacagggtggcggctgggcagagacgctcctcacctcccagacggggcagccgggcagaggcgctcctcacatcccagagggggcggccgggcagaggcgctccccacgtcccagacgatgggcggccgggcagagacgctcctcacttcctagacgggatggcggcggggaagaggcgctcctcacttcctagatgggatggcggccgggaagaggtgctcctcacttcctagactgggcggccgggcagaggggcttctcacatcccagacgatgggcagtcaggcagagacgctcctcacttcctagacggggtggcggccgggcagaggctgcaatctcagcactttgggaggccaaggcaggcggctggcaggtggaggttgtagcgagccgagatcacgccactgcactccagcctgggcaacattgagcactgagtgagcgagactccgtctgcaatcccggcaccttgggaggccgaggcgggcagatcactcgaggtcaggagctggagaccagcccggccaacacggcaaaaccccatctccaccaaaaaatacaaaaatcagtcaggcgtggcggcgcgtgcctgcaatcccaggcactcggcaggctgaggcaggagaatcaggcagggaggttgcagtgagctgagatcgcggcagtacagtccagccttggcaacagagggagaccgtggaaggcgggagtcggagacgagggagagggggagaccgtggaaagcgggaggtggagacgagggagagggagagggattatttctgtatgacttaataatgaatttctaagaaggtcacttagctcactgttgtctcttctaaaacatactcatctttccttttctcttctgtaggaactcattatacaatgacaaatggaggcagcattaacagttctacacatttactggatcttttggatgaaccaattccaggtgttggtacatatgatgatttccatactattgattgggtgcgagaaaaatgtaaagacagagaaaggcatagacgggtaagtgtttttagtaaaaatttttaaaaacatagtgcataattagatcttttaataatatatttctgccaatgatctcaggctgccaaatgtttacatttaatataagtaaatgtctacatttcatatgtggtacatgtttttttctttttctatgtttaatttttttagtttacttataccctgtaactttccagaaaggatttcaggtagctaaaaaacaaagaaatacaataagaagacaaaataagaaggaaagggaaaaatacagcacaggagttggggggaagaacaagccaagttccagatatggaggtcagcatgattttgggctttgagcagcccaccagctaaggcaaaaaaggaaactcattgcatagctcttacctatggaaaaagaagaaatctactgggggcagatggtcttgtgggattttgctgttttcttttatctcctttcccagcatttgattctgagatatttctcaatttggctcccaaataaagcttattgagtgttgtaatggtttactgttttttttaaaaatggctttaacatataaaagtacaacttatggatcctttttgtttgtggtcgtgacttactgataatataatccaaaatacattttttattttgtatttatttatttatttttgagacggagtctcagtcttctgcccatgctggagtatagtggtgtgatattggctcactgcaccctccgcctcctggattcaagcgatgctcctgcctcagcctcctgagtagctgagactacaaacgtacgccaccatgcctggctagtttttatacaaaatacgttttttaaaaaacaattttttttttggaggtcgggggaccgtcgcccattctgttgcccaaactggagtgcagtggtgcaatcttggctcactgcaacctctgcctcccaggttcaagcgattcttgtactcagcctcctgagtagctggaattataggtgtgtgccatcatgccaagctaatttttgtatttttagtagagatgaagtttcgccatgttggcgaggctagtctcagactcctggcctcaagtgattggctgacctcagcctcccaaagtagaaaatcttcttgaaaaataaaattccaaatctcaaaaggccctatataattttggtgttggaaatttacttgtcaatgaaaatgactatttacacaaattataagcttccatattaatatatatgtgtgtgaacctgaaattcaaattttattatattgtttatgaaaggtacagcctctgagattcatcagatggtatttacctttagggcatatctaaaaataaaatacagtacatgaaatccagtgctttaatccagtgattcttaaactttttgctctcagatcccctttaaactcttaaaagatattgaagagctccaaggaggctttgtttacgtggtttttatcaatggatatttaccatattagacactgaaactgaggattttaaaaaaaaataattcatttaaaaataacagtaacaaaacccattacatgttgacataaataacatttttacgaaactatattttcaaaaattagtgagagaatgacattgtgctacatttgttataaatctcattattgtctggcttaataaaacactgctggattctcatatctgcttttgcagtcaatatgttgtatgttgtttttatggaagtatgtgaagaaattcaacctcatacacagataatatagttggaaaagctatgagtattttaatagtcttttaagattattgcaaatattcttctttgatactacactaaagtgacagttgttagtttcttaaagattagttgtaatgtgtactttgaaactgcatcaatgaactttgtcttctgttacattaaaatccattgattttgaatatatgattttgtaacattatgcagtgatcatttagaaaatattgattcactgatttatgtggatcttttaaatgttgacacttatataatataatacaatattttaaaaatcacatttgttaattttacctttgatctattcagaaaagactctaagtattgggaacctatcatcctcacagtgatagatacaagtttcctaaaattctgatttttactggagagctcaaattctatcattggaaacaaatacacatttatttaacttaaaaatgacaggattacttggtttcattattgagaaaatacctgtcaaattcccaagtctggaaaaccatagtttgatgtcactctttcaagtaaaaatggcattccatgtaagaagtgtctagtttattatgcaactcaaataaattacgcaagtgcttttctttaggacataacttcatacatacttccacaagcagcagatgtgtgtagttatgcatagttccttatgcatggttcttatttcatcacacaaaatattaaaaagactcagtgattgagacgtagcagtttttactgcttcatcaaagatgctcttatttgaaactggcataatatgatttatttatttgattttactgggaagcatggcagtcaagaatgtaatgactgccagtacatttgagtgccactgcttgatttttgctatggagtcagcaattttgccactggttttgcattttcagtaaaaatgtcaacacagtgaaaaaggcacataatgtcttgtattattttgtaaacagttttatcttgcagaccccttgaaaaggtctcggggatcctccaaggtgccagtagaccgtactttgaaaatcactattttaatccaaagtgcctagatcagacacactataaatcctgtgtcttgtatgatcattaggtaaatacatttgtacttagaagtatacattcagagacattaacagtattcaggttgggatttaagtatattttaaagtgtggtacctagagagtatccatgacactatgttcataaaattttagagaaaactgagatcaaaggaaaccaaaacaggctggtcatagtggctcatgcctgtaatcccagtgctttggaaggttgaggcagaggatcgctggatcccaggagtttgagaccagcctgggcaaatatggagactatctctacacaacaaaacaaaaattagctgggtatagtgtcttgcgcctatagtcctagctactcggaaagctgaggtgggaggatcccttgagcctggaagttctaagttacagtgaattatgattgcaccactgccctccaacctgggtgaaacagcaagaccctgtcaccctccaaaacaaacaaaaaacacttttttctctgagtatgtaaatggttagtgtacagtccttgaaaacattgcaaatagtatagcaatatatgaagtagccagtatgtgtcctagctaattttatcaatcatctcttcctagaccaatcaaatatttttcaatattttgatccatgcttatatgaacaagattttttaaagctggaaaattccacacatttatatacttactattgttcttaaaattaattttttttttttttttttaagcagagtcttgctcttttgcccaggctgaagttcagtggtgcgatctcgactccctgcaacctctgccttccaggctcaagcagctctcgtgcttcagcaccccaagtaactgggattacaggcatacgccaccacactggctaatttttgtagtttaagtagagatgtggtttcgccatgttggccaggctggtctcaaactcccggcctcaagtgatccacctgtctcagcctcccaaaatgttgggattacaggtgggagccactgcgcccggcctacattaaattttaaagcctttctatgtcagtgcatatacccaacctaattctttttttccgtgaacttttttgttatgcttgtagccttcctaccccagattatttcgaagcaaattgtcattctgtaatttcaaatattactatttcagtattttacaaaatggttgcagtttaattgttgttccttttttatttattagcttgcatatttctatagagagtttaccccacatcaaccatttggattacctgaagtaagggtggtacaggaaagggagaaatcttgaaatactaggttccttagcatcctcaaagttgaccaatgagattttttgcttgtttggttgtttttttctgtgtcttcatggactcatggatttaagtatatttgtggtttaatcatcactgttattattcttattgatgttcatgttattttagattagtgggagcttttttagtttgctatctgtgtccttcgtcatgtccttagataatcctaatcctaatcctgattcatcgtagacatttcccgcagcaaacctggaatcagccatttctcaaggagctctctgattccattgaaggaaaatataatataggtacaatctaggcactaggtgatacttgttacttctgggttggctattgtttctagcctcctaagtttatatgactgtactaatttgaattcataactatgggactaaacttctaattcttaaatctgcatttcctttaagtcatgccaaaaatctgaacatcacaaacatagtcatttcgtttaccccacaatacacacatacaacattgtcagtataacagtaccaacaccatctccaacaatatgcctactgaaaaattttaggtaatctgtctccagcctcccaggtagctgggactgcaggtgcacaccaccatgcctggctaatttttttttttttttttttttttaagagactgggtcttgctatgttactcaggctggtctgaaatttctggcctctaacagtcctcctgcctttgccttccaaagtgcagagattacagacctgagccaccacgtctggcctatcctttatttattccaccaaagttatttatacaaattactttgttgtaaagtcccttggaatagtttcttctgtggcattatgttaccagttagatgcacctttgattcatttaactttacttcaatttttaaggtttgctttttagatttagttttgttttattatacatatatgaagtatttccacggttccaaagttaaatgaacaaaacaggcatgttcaaagaagtctagtttctatctctgtcccatccaacccattgtcttcttccccttataagtaataatttacatttttaacttgtggtttatcttctgatttttaaaaatataagcataaatatttatattcctgtcttttagcatgcttttagccatcttgcttttttcctgtataatgctaaatatatctcattctttttaattgctgcagaatttctcattacataggtatactgcaatttatttatctgatgctatgttgatgaacatttaaatgatttccagattttaggaacggtgatgattgaactctctgtacatatatcttttttacttggtacactccatcaagcaactacttaagtgactgactatgatgctgtgcaagcagttatataaagaaaacagcagtgactcagcctgaaaacggcttaatattatcatgttttcttacacattatttttattgaggaaaagcaacatggagtttagtgattatttttgaaagaaataacctatttctaattctaaagaatggttaatatctgtgtttggttgcttatagggtagaaggggtaaaattgcctcattcaacttagaacttaccgtgtcattttagtggggcgttgtgacttcaaatagacccgattcttgaaatagactgggtccatgtcctttgttgggacatggatgaagctggaaaccatcattctcagcaaactgtcgcaaggacaaaaaaccaaacatcgcatgttctcactcataggtgggaattgaacaatgagaacacatggacacaggaaggggaacatcacacactggggactgttgtggggtcggggagtggggagggatagcattaggagatatacctaatgctaaatgacgagttaatggatgcagcacaccatcatggcacatgtatacatatgtaacaaacctgcacattgtgcacatgtaccctaaaacttaaagtataataataaaaaaaaaaaaagaaatagactgggtcattgaattccagctgtagccctccttcagaacagttgagcactgaagtcctgggctgaaaattgactttttttttttttttgagatggagtctagctctgtcacccaggctggagtgcagtggcacgatctctgctcactgccacctccgcctcccggtttcaagtgattctcctgcctcagcttcccaagtagctgggattacaggcgttcgccaccacacccagctaatttctgtatttttagtagagaaggggtttcactgtgttggccagactggtcttgaacttctgacctcgtgatccacctgcttcggactcccaaagtgctgggattacaagcgtgagccaccacacctggccaaaaatatgggtttctaaagcaacagtcctagtacaacagaagagaggtgttgactagttagggatttaggtttagaagtacattcttagtaagagaggtgagacttaccttcttgtgttttagtatagtgagatctggatcaaatctattactcttattaatctcctaacttcctacactatatccagtagaggacacttttgccttacacagtaaagaaagagcctctggactctaccaatgggatcggagctctccaaacctgcatattaaaaggcctataagttttggggggtccctttgtccacatgattattctgtaatacattgtatttatggacatggtattattatacacagatcctgtcttttaaagaacattataatccacttaactgctaggaccagagaatgaccgataattcaaaccatattgtcttacagaagacatatataaaagatggttatgtgtaccaattgaggttcaaatttgattcaatttaaaacaatctaggccagattttatatagtttgtggaccctttgcactcaaatctcaaggttcttattaaaatgcagatcttggctgggcacggtggctcacacctgtaatcccagcactttgggagcccaaggcaggtagatcatttgagctcagaagttcaagaccagtctggccaacatagcgaggcccagtctcattgaaagaaaaaaaattttttaataaaaaataaaagcagatcttgggtaaagacatgtagtctggtttacaggtattaacaactgtctgtaatgtagtgattttgctccagacttaccttttccattatttagttctgaaattactgttctatgtatggtaaatgagaaaaattgctagattctagaactgtggcttctattcatagttggaaaaatgaagcataaacatttctaatttcagatcaacagcaaaaagaaagaatcagcatgggaaatgacaaaaagtttgtatgatgcgtggtcaggatggctagtagtaacactaacaggattggcatcaggtaaagaaaatttttcaagcaatccttttttagttaacagaagtataaactgttcttccctccttccctcaattttttttcaggtaccattggattttaaaaagcatttgtttctcttcttcaaaaaatctccttaaatataagactaggaggcagaggcttccaagtctagtcttggctctatcactttacgtgtttatccagcttggttgatctttctggactcagtttctatatctgtaaaataagtggtttggatcagatgatcaataaagtatcttttgatattaacatcgtaataaatagctaatatttcttgagtgcttcctatgtgttgtacactgttctaaaaacttgacatgtatttaaacctcaccggaatcctgtggtaccagtgctgtcattatcaccattttgcagatgaggagactgaagcagaagaaaagtaacttagtttgactgaggtcatacagtttagtaaatggctaaaccaggatttgaattaaagccttctagctcaagacctatccccttcatcaccctgctatacagcgtggccacaaagtcccaatgtgtgagattttaagaaagagctgttgaggacctgaaaacaaatattaagcactgttataatcactttcagcttccatgatggaagattatgttcagaagaccataaaaattaaaatttttgtggagaataaagtactgataattctaattggcatgcatagtaattttatggcctctgtgtatgtaacccactgatctctttatgtaagaaggacccagatttgaccataaatttgtgtattttttatattctcacaataaaataatcttgatatatggttttctgtaatttaagaaaatattattcctatgagtttcaataattatttctaatggacattaaattttaatgaaattgacatcatttataagtctgttaattaagttatcgattgaaaattagatttgtgaacctcctgccaagtagctgtcttttgaagatattttagtatcttttaaacattgtttttcagatcacaattaatttgaatgatgtaactttttaaaattccaaacaaaaatagcacttttattgtaaaaaataactctttacagtttataactaaaatttgaaaatcttaaatttatatgtagttcataaatgaccctttatttaggagtctcctgctttctacttgccttttaactagattgttctcgactcccaaaaaattgacttaatttttttaccatctccaacatgtttttataggggcactggccggattaatagacattgctgccgattggatgactgacctaaaggagggcatttgccttagtgcgttgtggtacaaccacgaacagtgctgttggggatctaatgaaacaacatttgaagagagggataaatgtccacagtggaaaacatgggcagaattaatcataggtcaagcagaggtaagtcttgctttgtctcaagatgaattaataattgatatagcaaaatgtttccaattcatttaattatagaactaatcacatattagatgattacatacacatcaaatggatccaccctcaacacattgcagcaagaaagaattaagtgcaatattgtttcaagtagcttttttattagttaactgcatagtcatataacaaatcctctggattgtggtgcaaatatatttgagctgtagtagaaaagaagtgatagttattgcagtaagatctgtgtaaagttactaagaagtcaagttattaaaactaatatattactaagattgggaagtttgaattatgaaagtattatcaaataatttagtaaaatcaacctacgtagagatacattgaagataatcagacatttttatttgtggcattacggcatttaaatgattgatttactatgatctacaaagaacattttagaacttaggatgttacatgtatattttttacatgatgacatggatatattttttaaattttgttttagctgaactttagagctaaaaggtatacatttgcggtaagatgagtagtatgctgtttctcacctggcttaattgaattgagtttaatgatctggaaagttgcagcagaatgaaatctgagtggtgatgcaatttgtttccactgtttccaaaaagtggtttgtaggcagagattgaagtatagctgagatgtgttggtaacaagactttagggattaggaaaaagattaaatgtgctcagggttccttggtatatgtaggcattaatttttggactctacttaaatattttgttcatataaagtttttattattgtggaaataaaccaggagacttttacacattttactgaagtttcttttctttctttttttttttttttttttggccggtgggatggagtctcactctgttgcccaggctggagcgcagtggcacgatctcggctccctgcaacctccgcttctggggtttaagcgattcttctacctcagcctcccgagtagctggtattacaggcgtgcgccaccatgcccagctaatttttgtatttttaatagcaacggggtttcaccacattggccaagctagtctcgaactcctgacctcaggtgatccacccgcctcaacctccccagtgctgggattacaggcgtgagccaccatgcctggccgtttactgaagtttcttatgacaagcatttgcattagaggtgcaatgtaaattaaattcatactctcgaactattttctttttagggtcctggttcttatatcatgaactacataatgtacatcttctgggccttgagttttgcctttcttgcagtttccctggtaaaggtatttgctccatatgcctgtggctctggaattccagaggtaagccaagtaatatttagtgtcattaaacattattatgatgcttatctttttgaccttagtgataataaaagttggcttttctggagggaggggatagtttgttcataatatgaaaaaaaaatttttttaagtataagctgatggtagacatcattgaaaaatattgttccccatagtcatttggtcatttactgtgaaggctgattttttttttctctcaccactaatttaacacatgactaggcaaattttcagactatttagttaaacatcaagagcctggaagaagtatcttgtgacctaatgttctttgacgggttagttgttactttgctgttatgaccctgaattttttttttttgagactgagtcttgtgctgtcgcccagactggagtgcagtggcgcaatctcagctcactgcaacctctgcgtcccaggctcaagcaattcttgtgtctcagcctcctgaggagttgcgattgcaggcacctgtcaccatgccctgctaatttttgcatttttttgtttgttttttttttttagtagagatggggtttcaccatgttggccaggctggtctcaaactcctaacctcaagtgatcacccgcctcagcctcccaaagtgctgggattacaggtgtgagccaccacacgtggctatgaccctgattttgattcattcactttttataattaccttttgattagataagttaattattcttgaatttggccattttatgctttgagaaagtagttaatcacagtgggtcaacagtacaaacttttgggttttatttttcatcacaataaagtagagttatacataggattgattgaacttgatttgaacttatctcttctcttttatttttctgtagttaaataagttaccaactttttcctaatacatttctttttaaaatggaattgtattgatctttaagtttgtattaagaatatctttcataaaaagcaatatcatgcagtatataacagttgttactcattcttgatacataaaaaactattgcacataattacagtactcagagaaaacataatattcttatttctaacataatgtccaaaatatatttaaaatattatgcttatttttacaacagaaatattcaaatttgccctttttttggttatgtaattataatccttataattaaggtctgtattcattttaacatggcctgatattttgattttgttcctgagatagtgttgccctctctcctttcttgggtagagaattagattataatatcaatttattatatgtagcataataggcaaagttttcgaaaaattaactgtaaatttttctgtagactgctaaaatttgcaaggttgtttttgtgcataaaacaagaaaataacttggattcgttacattctcatgtttcttaaaggacattaagctgccttaatctttgccttgtagattaaaactattttaagtggattcatcatcagaggttacttgggaaaatggactttaatgattaaaaccatcacattagtcctggctgtggcatcaggtttgagtttaggaaaagaaggtcccctggtacatgttgcctgttgctgcggaaatatcttttcctacctctttccaaagtatagcacaaacgaagctaaaaaaagggaggtaagtgtcttttgtagttaatttgactgaaaaatatatattatatagtatttatttaagtaaagaatttcttagtgtaaaaataataaattctgtattcagataaaaaattttgagatttgtgcttctgtttttcctgaataatctataacatctttctagaatccattcccagtgctgctcagttcgtcttacattttagagaagctttagatagacagctggtgtccattgggtttcagctgcatttcacgaagatcttcctgttatcactttaccttacatctttcctcttctgaagtgttttctaagcttagctttgtttttcactcttactttcaacattaagaggttgggaaatcttaatagctatgttttcctcctggaggcagtgtctggtgccagtgtaagtggtgtgtgatatgaaaaatgctatccagtgctatggggaagttctgagggcctttagaagctcttgaagtttaaatcagaaattcacattaaagagattacaggaaatccttttcatttgattgtttaaggcaatttcctttaccatttctttaggccagcctgagatcttctacaagaccttgaaaccttatatatattatggatttcctctgatgtttccatattgctctgggcattttcctgaatcctttatattagctctagactttgggagcccagtcccttcctattttccaaatctaaatctacagccctagatggtacagagatctttgagtttttaagatatgattttttgaaaaacatctcattaaatactggcagaaccttttcatcttgttgagttttttaatgtactgtaaccaaaaaagtagaatattttatcaaactgtttaatcttcaattgaaataattctagtacattttaatgttcgcattaaaatattgtccttgcattggacgtagatatcccaaaagtggaatacttcagattgtcgtagtttcatctctgaataattgtgattccagtactttataacaaaaatagctagcattattgattactttctgtgtatctggtactgtggcagatactttacttggattttaatacttaatttcacagtaatttagtaatatggccctgttatcctcatttagtgattagtaaactagggctgaaaacagctaactaacttgcccgagactacatacctagtaagtggtggaacgtaggttaaaattcatttttctttgacttcaaagtctgtggtcttacctacttacattactgcccttacgactatgtgggtatatatttgtgtgtgttcaaaacaaactcaaaaccatcctgtagcgtagcaagttagtggctaagatgaagctagagcatttgcctcctcaattcaattccattactttctgttgtacctttatattttttggtaagacttttacttattctaagttcaaaaaatgtaatttattagatgtttgagaaattaagtttacctaaattttaatgttcatactgtagtgattagttaatgtttaatacgttgttattctgtcaccttagtgtatatataaatggcaagaattcacggttagttgaaagcattaaggtcccatagttttgtgtagacaagaggggagagcgttgatatttttaaattaaatgcttcttagatacgtatgaaatggattaaaacatgtatatgagttatagatacctaggtgttagtttggttgtaaattcaggatcaggacattcaaataaatatgtttgctttcctcttagtggaggaaaaaaaaaagaagctaaatttgctccctttcctccccaaataagcagagtctacattttaatgccaacaatttgattaaaacaaatatttatttacttttaattcaccaaacttttataaagtatttactggtgccaggcactgttctaaagcactctgtatatatttactcagtccttaagagctaagtaatattatcacgtttccattttagagaaaactgaggcacatataggttaggttatctacccatagccatacagctagtaagtagcagagccatgatttcaacacagcagcctgactatggagttcatgatcttaaccatttacagcttaatttttattatttataatttctcttctggaaatgtaacaattgaccatttgaagaaatactttaggtagctttggatatttgctgtattaaagtagtgaaagtaatacagacacttggctgggcgcggtggctcacgcctataatcccagcattttggtaggttgaggcaggcagatcacctaaggtcaggaattcgagaccagtgttgccaacatggtgaaaccccgtctctactaaaaatacaaaaattagccgggcgtggtggcaggcgcctgtaatcccagctactcgggaggctgaggcaggagaatcacttgaacccaggaggtggaggttgcagtgagctgagacgacgccattgcactccagcctgagaaacaagagagaaactctgtctcaaaaaaaataaaggaatacagactcttagaaaaataattacaaataaaaccctagtgaaattataggtatagttaggtatagttggcttacaggtgggaagtagaccattaccaactgatagactggggagctggagagaggacacggaagagtgtccttggatttttcttttcctttaatttttttgtagaggtgttggttggtgagactgtaacttgaggagctgttgtgtgtgctttcagaatgaggctctctagattgatagtattttagcagtatttcagaatgcatagggtagtgaaaatatagggaatcttacaaggtcttcggttccctgcatatcttgctacgatttggaatagagtatttatggtggagcagttagctctaaaatttgaagaaatgatatcctatttaaaaatagctccccatcccagttactgccctcccctcttacctacacaaacatacgtcttgaaaattgtctatattcattgcctcctcctctttacaccctattcacattagtatatctggcaaaaattttttttaactgaatggtaaatgcatgactgacctttcaattaaagccaggagaaagaaacaaatcttaatagaagaaatgaatagttaccctttgcttagggagcaaggaaacatgcaagttaaattcagaaaatccatttggaaaattcaagtaacatgaagaatttttatttggtatgtttgaatttctatgaaattatgaaataagccatatcctctttctaggtgctatcagctgcctcagctgcaggggtttctgtagcttttggtgcaccaattggaggagttctttttagcctggaagaggtaggtgaaaagaatacaacaattaaaattatatataattaccattacaaatatatttcacacatttcagttttgtaggtgatgtaataggtagagactttgttttcaaatttatttttctaaagttgttttccactcattcttaataaaaagtaaatgttattcatgctccatacctggaggaaactttttaaaaatttattaatgtatgaatgttagtaattatttaaaatctaactttgttgacatatttaaaagtaagaagatgtgaatttgacttaatagaggacatgtgaaacaatctatttccattggctaaattctgtatttttagtagagatggaatttcaccatgttggccaggctgtttttttgtggggtttttttgttttgttttgttttgtttttgtttttgagacggagtttcactcttgttgcccaggctggagtgcaatggcgcgatcttggctcactgcaacctccgcctccagggttcaagtgattctcctgcctcagcctcccaagtagtttttgtttaaaaaattttaatcaattcctatgttgtgttttaaagtttttcccatgtgattatttctgatacagttagtgatgttaaagaaaataattttagtgacttcagtggattattttgtttttgttttcttaataggtgtttaagacttttctttttacataaaaatgtaaccaggaatttttttttaattttttttgacaaataataattgtttttgtttatggggtataatgtgatgtgtctatacatgtatacattgcggaataatcaaatcagagtgattagcaaatccctcaaatatttattatgtccttgtggtggtgagaacatttaaaatcctcttttagctattttgaaatatataatacatattattaactgtggtcatcttactgtgcaatagaacaccagaacttattcctcctctgtaagttcatacccgttgactaatgtctcccctttccctgttcacctccccaacccctagcctctggtaacccctattctactctctacttctatgaatttaactcttttagttcaagatgtttttaaatgtacttttttcttttagttgtttgtattctttttttttttttaatgtagaagaggcaaattaaatgcattataagttaacaggagttggtgatggtacatttatttttaactaccatgattgaattgaatgtgaaactcattttgaatataaaacagcactaggtattctattagtatttattagacatttatgatcaattgatactgtcaatttgtaatgatgatcaccatctccaaaaataataataacatcaatttttcttattacagtaaaatccattacatgtaaattctaactacagcaaaatttagagctaggatatttaccattcaagttataatatatcagaaacatcttataaaattatagcattaatttttcttttccttttcttttttttaggttagctattattttcctctcaaaactttatggagatcattttttgctgctttagtggctgcatttgttttgaggtccatcaatccatttggtaacagccgtctggtccttttttatgtggagtatcatacaccatggtacctttttgaactgtttccttttattcttctaggggtatttggagggctttggggagcctttttcattagggcaaatattgcctggtgtcgtcgacgcaagtccacgaaatttggaaagtatcccgttctggaagtcattattgttgcagccattactgctgtgatagccttccctaatccatacactaggctaaacaccagtgaactgatcaaagagctttttacagactgtggtcccctggaatcctcttctctttgtgactacagaaatgacatgaatgccagtaaaattgtcgatgacattcctgatcgtccagcaggcattggagtatattcagctatatggcagttatgcctggcactcatatttaaaatcataatgacagtattcacttttggcatcaaggtaagtgctaatgtgaggtgatatttgggtaattttggcatgttcaaaacttatatgtggaatgagagaggttgttgtttcataaatgactgaaaaaagtacttatcttttgagtttaattttaagtaatgaaaaagataattccttagcatatattgttgaccatgttatctgttgctatttaacaaattaccccccaaaacttagcagcttaaggtaactacttattttgttcttgatattgagtcaacgacttgggaagggctcaactgggcaatttttgcttgtggtctttcatatagttgttattagacatggcgagggctaatcatctcaaagcttctttttttcgtttcctttttaaaaaactgtttttgtggatacacagtagctatatatagttttggggtatatgaagtattttgatagaggcatggagtgcataataatctcagggtaaatggagtatccatcacctcaagcatttatcccttgtgttacaaacaatccaattacactcttaattatttttaagtgtacaattaaattattgaatatagttcaaagacttcttcattcatgactagcacctaggctaaaaaaattcagacacctgggctcctgggatcaatcacgcatactgtgtctcttgtgctcactcccgctgtctctctctctttctctcgcttcctttttcctctctctctgtggttttctagggtggtggcctcagggaattggatttcttatattatagctcaggattcccaagagggctgtttttaatgtagccaaagaagtcttgcagcgtgacttgttttattctattcattgaggcagtcacagaggcccgaccacattcagaggagggacatacacttgctgggacaagtgtaagagaattcatgatcatgttttaaaaccacttttattagtttcctattgctgctgtaataaattaccacaacttaatggcttaaaagccacacaaatttaatatcttacagttctgcaaatcaaaagtctgaaacggatctcactgtgctaaaattaaggtgttcgtagggcattctggaggctgtaggagagagtcttgttttttgccttttctggctattaaaagctgccagcattccttggctcctggctgtctatttgcatcttcaaagccagcagtagctggtcaagtctttctcttgtctcatcaccctgacccaaactctgctaaatctcccttccacatttgaaaaacctttgtgattactttaggcccacgcagataaatcagaaaataatctcctttttcaaggtcagttgcttcgaaactttctttctgccaccttgattcctccttgccatgcaacgtaatgtaatcacaggttctgggaattaagttatggacatctttgatgagccattattctgcctcataccagtatagggtattagcttgaaaggacactgcagactcagttaaattactagatctataaatacatgcctttttccatcaagaaattaaggcagctgggtcttatgccctgggacattgcttcttttggatttataaaataacaaaatttgttgattaatggtctatcagtaaatataatttcttatgtgactatcagtgatatatatggggaagcacatatcagcttattcttgttctttaaattactacccctgtacttcatgtaatagtatttgctagtgatgatgtgcttttacagatgtaaattaatgtggaataacagctttgtttctacaaaattagagtggttttagtttttgaaataaggtctcttttctcttgtcctaagtctgtagtccactgagtatctagagttaaataatagaaaagcctggccaggcgcagtggctcacacctgtaatcccagctctttgggaggccgaggcgggcagatcacaatgtcaggagatcgagaccatcctggctaatgcggtgaaaccccgtctttactaaaaatacaaaaattagccaggcgtggtggcaggtgtctgtaatcccggctactcgagaggctgaggcaagagaatcacttaaacccaggaggtggaggttgcaatgagccaagatcacaccactgcactccagcccaggcaacagggcaagacactgtctcaaaaaataataataagaagaaaataataatagtaatagaaaagcctaaacattttacctttttttcttagggaatcaagttaaaagagctgttaaagctctttttcctacaataagtaagtgttgggtaaatcccaactttctcacagtcagttgaactacaagaagctggaggcaattggcaggcctttgttaagtcccacctttgactcagctctggctgaaggatcatacctggcaagagagtgtaaaacacactttgattttttctattgtttatccttttaatgatcctaagagactcaagagtacatgccatcattttgtgtttggctcatttcatattcagaggagtttattactctttcagtagtttgttcgtttgtttgttttttgagacaggatctcgcctttttgcccagactagagggcagtgttgcagtcttggctcactgtaacctccacctcccaggttcaagcgattctcctgcctcagcctcccaagtagctgggattacaggtgtgggccatcacacccggctaatttttgtgtttttagtagagatgtgattttgccatgttggccaggctggtctggaactcctgacctcaggtgatcctttgggaggccttggcctcccagagtgctaggattataggtgtgagccactgaacctggcctctttcagtagtctttaaatgatcttgcttatggtgcttcttatccctgtttattatccttattaaatttaatcaataaatatttttctctttttaattgattcatataaatagacttacctgagagatataggttcagttcagagcaccacaataaagtgaatatcataataaagcaagtcacataaaagtcttagtttcttagtgcatataaaagttctgtttacactatgctgtagtcttatgtgtacaatagcattatgtcttttaaaaaagtaatactttaatttaaaaatacttgattgctaaaaaatgctaatagtaatctgagtcttcagtgaattgtaatctgttttgcttctgtagggtcttgccttgatattggtggttgctagaggtaggactggctgtagcaattcttaaaataagataacagtgaaatttgccgcattgattgacactgcctttcatgaaagatttctctgtagcatgtgatgctgtttgataccattttacctacagtagaccttcttttcaaaattagagtcatcctctcaaaccctgctactgctttatcaactaagtttaaggaaaattcaaaatcttttgtccttttaacaatgttcacaacatctttaccaggactggattctacctcaagaaaccactttctttgctcatccataagaagtaactccttatacattcaagttttttaaatgagattctagcaattcagtcacatctttaggctacgcttatcattctagttctcttgctatttccaccactctgtagttacttcttcaactgaagtcttgaacccctcagagtcattcatgagagttggaatcaacttcttccaaactcctgttaatattgatattttgacctcctcccatgaaacgtgaatgttctggatggcatctagaatggtgactactttttgaacattttcaatttattttgcccggatcaatcagagaagttgttatcagtggtgggtttccaagttgtcaggggcgaaccatacagatcttcagcaacctcaactcttgccttctcagaggaaagaattctacggagggacataaggcagaaaaagagactgaggcaagttttagagcaggagtgaaagtttattattaaaaagctttagagtgggaatgaaaagaaattaaaatacacttgaaagagggccaagtgggcatcttggaagacaagtgccccatttgaccttggacttagggttttatatgttggcatacttctggcatcttgcatccctattccattgattcttcttttggggtgagttgcccacatgctcagtggcctgctagcacttgggaggggagtgtgcacagtgtatttactggagttgtatgcatgcttacctgaggtgtttgttgcttaccagccaaatgtccctaggaggtcatattcataaactccatgattttgcctctaaatgtgcatgcttgagcccactcacccaactcctgggatcttatcggaaagctgccgatcgctagtttcaggtgtttctatctattggaagatggcctttccctgatgctggctgcaaccaattattactttagagagagagcatgagagctgtctcaccatcatcacctgatggttgcctgacattcctggtggggttgggaggatgcctgtcctgccctgctcatgcctgactagctacctgctgtaacaaaagtactatctatggtagctgtagccataggaaatgcatttcttcagtaaaacttaaaagtcaaaattagtctttaaaacaacatgaatctccttgtacatctccatcagagctcttggaagaccaggtgcattattagtgatgagtaatgttttaaaaggaatctttttgtctgagcagtaggtctcaacagtgggcttaaaatagttagtaaaccatgctgtaaacagatatgctgttatccaggctttgttattccatttatagagcacagagagagtagattggcataatttaaggattacttaaaaaaaaagtctttgattactctcaaaaaaaagtcacgtctctcactttatatcaacagctaaaaatggccaggtattgtggctcacgcctgtaatctccatgctttgggaggccaaggcagaaggatcacttgaggtcaggagttagagactaacctgggcaacatagtaagacccatctctacaaaaaaaaaaaaaaaaaaaagaaagccaggtgtggtggtgcacgcctgtagtcccagctactcacgaggctgagtcggcaggatcacgcccagccaagagacgtgacttctgctttcagttgtacacttagagaccattgtagggttcttagttggactaatttcaatatcattgggtctcagggaatagggaagcctgagaagagggagagacaggggaacagccagttagtggagcagtcagaccacatacaacacttattaagttcactttcttctatgggcatggttcatggtgcagtaaaacaactgtaacaggaacatcaaagatcattaatcacagagcactgtaacatataataatagtgaaaattttcaaagtattgagagaattagcaaaatatgatacagagacacaaagtgaccacatgctgttggaaaagtagtgctgatggactagcttgatgcaaggatgtcataaacctcaatttgtgaaaactgcaacatgtgtgaagcacagtaacacaaagcatagtaaaacaagatatgtctgtatatcagtcaaaatattgggcaactctgataagtttgtccacttaacattgtaccacttaagatgaatagcatctaccatttccgtcatttgtaaatatataggaggacataatcacataatcttgaagtaaaagacagtgcttaaaactgaatcagttaagttttatgaaaaatacttcatattgtacttttaaaaatatatattttttaatttcaatagcttttgggttacaagtggttttggttacgtggatgaattctataatggtgaagtctaagattttactgcaactgtcacccaagtagtatatattgtatccagcatattgtccttttttttttcttttttttttttcatttcaccatggactaatgaaaattttgttagggactgacattagggcacccttgagctaccttgagctaaaggaaataacccttgaatttttttctgtttggcctagagaatgtggtttgttttgtaactgaattcatgggattgttaaggtacaagattttgctttagttttatttgtactaggattttgctatattaatacaatgtgaaaagaatcaaaagtgttagaaataaatgcatagaatgtaagtttcaggcatgtgagtagaggatctctgctccataaagagttctgttgttgttataggttccatcaggcttgttcatccccagcatggccattggagcgatcgcaggaaggattgtggggattgcggtggagcagcttgcctactatcaccacgactggtttatctttaaggagtggtgtgaggtcggggctgattgcattacacctggcctttatgccatggttggtgctgctgcatgcttaggtaatatggctgtgtctgcctgtgtgtggatgtttgcaagtctgagagagccaagagaaagtgggacacattcttgcttaattggtgggcggattggttgagtaaaggagggtgccaggaggagatgttttaacagataagaaacagtagtactattagggtattatacagtaccggttttctgtcttacaacatttgttaatacaagaatttaatggcattagcatattgtaatataacttaatacactatggcagaagccatctaagtacaacataagcttaatttgaatcctgaccaaagatgtctttgattctttcatcgttaaggatcttggcttacctataacaactatagcataatacctaagattagcattgcaacagagtttcagagtaggtttactttggttctgaaatgatttattgttagccttagtaaaagatgtatttacccatgctccatcatctaaggtatatttgtaacaaaatgagaaaaggtaacttcattttaatgagaagaaaagcaaaatacctacattaagtacttgagtctatttaatgtctgttagggcaggaaaaaatggttattgcttttcatatttaaaatatcagctacactctggtgataatattaatggttgccattttgaccagttttgtttagtgaataaaaattatgtgattattgatctttaaaaatgtaatatcaattaaaaggaaaggacagactcattttcaccaaagtagcaagtatttattaaatgtccactttctttttagcattgtgctagatacagtgcataatacaaaaagaacatggacccaatctcgactctaatcaagttgaggagacaagatgaacactgagaatacaatagtgaggaatactaacaaatatatacaaggttaaaagagtctaagtatggtaggaatataggggaagaaagagctgaagtacttcaggaagagtagaacatgagctttatttaaaagattagcagaatttaaggaaaaggtgactttgttgaagattataatgtgaagacaaaggaacgaggatgggaataaattttgtattcatgaggctttgaagaaattgactctagagagtatattttgggtacttttgggaaatgaagttggattagtgagaaggaacagattatgaaaagacaagaaacctgattaatgtcaggatgattttatatttgaagttggtcagatttatggcagtcctggctttgccatttttagtttgatgactttgagaaagttccttcttgaagttttaattttctgtatataaaaagtaataacacctggtgatctgctaggtttgttttgaggattatatgagataaaatgcatgcaaaactgttataatagtgcctggtaaaataagtgcctagttttaaaaacaagtctttgtaaactgcttaggacatgcctggtatagggtaggtatgtaatacatagtaggtaggatctgtctccttgctatttttaggtaaaaaaacaaaaggaagagcttcagcttaatacagtatgaactgacgagccctggtaggtttttgagcaaaagagcaacacagtaaaagtagtacttaggaaagattaacaagggaacatggcttatacagtggtaatggggcctggagtcaaggaggtaagataaaatggtattataattaaggaatagccaggcacgatggcacatgcatgtaatgccagctactggagaggctgaggtgggaggatcatgggagtccaggagtttgagaccagcctgggcaactgagtgagaccccaaatcctaaaaaatacaaagtaaaaaaggaataaagtcatgagggcttggactggattgataacagtgagaataccgagaaagggaccataggcagtgtgaacgcagctcactgcagcctcaaaccccagcccaaacgagcctcccacctcagcctcccaagtagctgggaccacagacatacaccaccatgcatgactactttttttagtttttacttttgtagagacagggtctcactgtattgcccaggctggtctcaaactccttgacttaagtgatcttcctgccttggcctcccaaagtgattacaggcatgagccacagtgcctggcccaaatagttttctgtgagtgaatattacttgcatcgttaatgtaaatcaaaggcatcaaagtattttactctttttgaaaaaaatttagaggagaaatttattatattaatattctacccatatatgagtttaatttgtaaattgtagcaaagcatgatgtgctttactaaattcctttataattagaataagcttttataagggtgaaattatgtctttgctacagcactaaaccaaaatggcaaaattgttttagtcggtaagctttgcttttttaaaatatgaaataaacaggtttttaaaatgttattttaatagtcttctctgttataaacaaagaaaattggtgtttctctagagcttattaaaagtagtgattattgtcctaaaagaggagtagcagttttagatgctaatgcttttccctgactgagttctatttgccatttagttttaactgcctagtgcaaaaattctaataaaatgtaatgatgaggatcctgtccttcctgaccagtgggtgcttacttttttcaggtggtgtgacaagaatgactgtctccctggtggttattgtttttgagcttactggaggcttggaatatattgttccccttatggctgcagtcatgaccagtaaatgggttggagatgcctttggcagggaaggcatttatgaagcacacatccgattaaatggataccctttcttggatgcaaaagaagaattcactcataccaccctggctgctgacgttatgagacctcgaaggaatgatcctcccttagctgtcctgacacaggacaatatgacagtggatgatatagaaaacatgattaatgaaaccagctacaatggatttcctgtcataatgtcaaaagaatctcagagattagtgggatttgccctcagaagagacctgacaattgcaataggtaccctttcaaaaatatatatatgtatatatgagatggatttctggaagaaaggaaagcaataagcagtaacatttaatgggttggatttgtgggggcaagggacattattttatgtcccttaaaatcttctgttctttaggaaaggaaggtatgcttcagtggatgattttctgctatttagcagaaaatctgtatttcagttttgtcttttgatctggcattgtaccagaaattggagtcagattattttcccactcagataagcctagataagttgatcttggttattcaaaacagcatgtaatataagaccttagctaaatgcattcagtcaaatacattcttgtatttaataaagttggcttattggaatacaagttattgaaaatctcatcttcatcagtctctttcatattagaataacactgttttgctttatcagtctttggggttagaattataatattaatttataatatctgatttaaagtgacaatcactgagatttttatttctgatcaaatgccaggttgaaaaagtataacgtatcagtcctgttgtgttttatgcagactttcctgaaaatactgtttaaaggtattagccatagtgtatttcttggagataaattaaactttctatagttctgtttctctaaaatttgtttttctctttaccttatagtcccgcagtattgatgaggagaccattaagacttaatatttttttgacacaatcttatatctcttcctccaacccctaaaaagtgactgaggataggtacatcaagccattgctttgttactccccaggttttagtgccagaccctgaatggaagtgtcaagcctttggcctgtctgaaaggtcattcctgtgagcatatcatctcccttccagcttacctctgtggccattgcaaaaggatttaaaaataatttttgtgccatttgaatggcacaagaccagacagtgtatgtgggggagtgtttctcaaatcaaactggaaactctttaatttgtaagaaccattaagcagagagagaaaaaagaaaggaaaagaaaaaagatcctacagagaacaccctgttcagtttgggaacaggctacagctttggatttttcaaggcctagcattcccatcattctaaattttacttagctaatacaatagtagttgccagagctgatgacatagtattttgtcatgcttggctccgttcaagcattttagttttttagccattaccatggctagacccagtcaaaagaatttcattgtttaagattcccattctctagtttttactagtagccagccaaagaaaagaaaaaggaggtcagaatttcggtatttacatagaaatttaaggggaaaaggccaggcatgtttttaaagtgtggaaattaagaactattcattatcccactgattgtgtggatgtgttttttaaagttttgttactgtcttgagagagagaatattgagataggacataatgttggtttaagggaatgagggtactttctgtaggtgaggtgccaagccatgtcatcagaaatgttagtcacatgactttctaagcacaccttaaatgttttaccgtgtatgtttttgtaaagttttaaatttttaactgggaaaaacagacctgtatattaagttttatatatatatataaatttaaaattacatatatatgtttatatatgtaacttttatatgggagagatatatatttctatatcctctataaaaaaacatatctatatatgaaaattatgtacgtaaatgttaatttataattaattatataaatattaacataattacattatatatatagaaaacctagtgtacagatctgtatataaattaaaaatgtatgtgttatatatagttacatcatataatacatataattgatatatataatgataaatactttattgaaggatgaaaaaatttccatgctgtctcataaaataagatggttgacatatgctaaactagatagattctcctgtttcatactaaagcagaatgttgtaaaatattaaattcaaatgagatgtctcagattaaggccatttcaacaggaatgctgagactttaaaaaaaaaaaaagtctgaggctgggcgtggtggctcatgcctgtaatcccagcactttgggaagctgaagcaggtggatcacttgaggccaggagtttgagaccagcctggccaatgtggtgaaatcccgcctctactaaaatacaaaaaaaatacatgggtgtggtgacgcatgcctataattccagctacttgggaggctgaggcaggagaatcacttgaacctgggaggtggagattgcagtaagccccaccactgcactccagcctgggcgaagagcaaaaccctgtctcaaaaaaaaaaaaagcctgaattatatcagcaaatgaaaactgtaatgttgttctctgtttcagaggcccttgaatgaatagcactaaaaatattttttaaaaaatgaagaaaatgaaaattgtaatgttccttatttaaaaggcccttgaatgagtagcatcaaaaatatttttaaatgggaggccagggtgggaggtttgtttggcaccaggagatcaagaccagcttgggtaacatagcaagacctttgtctctaccaaaaaaaaaaaattgtctgggtgtggtggtgccacctgtattcctagctactgggaacgctgatgcaggaggatccctgggactctagagtccagagtgagaccctgtctctaaaacaaacaaacaaacaaaaactgtatttatgtaaaagtaatacttgttttttaaattttatttatttttaattgataaaaattgtatgtatgtttatgtgatgtatatattgtggaatggttaaatcaggctaattaactcagattttttgtgtgtgtggggagaatatctaaaatccctctccttagcagtttccaaatgaaatgaaagaataaaagtgatttatttttttgagacagcatctcaccctgtttctcaggctggaatgcagtggcacgatcttggcttacttgatcctcgacttccctggcatccggtgatcctcccacttcactctcctaattagctaggactacaggcatgcgccaccatgactggctaatttttgtatttcttgtataggcaaggttttgccatgttgcccaggctggtttcaagctcctgggctcaaacgatccacctgcctcagcctcctgaagtgctgggattacaagtgtgagccaccacacctggcgaaaagtgttatttttttaaatgacaaatttaagtcaaagagattgaatgttcacttctggtactttgtatataagagaaacattccattaaataattttttaaacatttctaaaattacatattttgtcattaaatgtttaaacaatcagtataatttcattgatacagtgtttgttattttgtcggtgtttaagattgataattggggttagttttaattcagaatgttattctatttaatgtcacacttcatgtctttttattttgtatatctattaatgaattattttagctatagttattactgttttagagatgaggtcttctatgttgcccagggtagacttgaactcctgggcttcagcaatcccctcctcaacctccggagcacatgagattagagacgtgtgccactgtatctggcctgctgtagttatttttaattcttttgtctttcaacttttatactagagttagaaatgatttacaaaccctattgcagttttagagcgttatgaatttgactatatatttcttataacaacttaacttcagttgcttacaaaaactacagagttttactcccccgtccacattttatactattgatgtcacactttacatctttttattttgtgaatccattaatgatacttctggtagtttttacactccactattcagttgtcagacaccattcagttgttagattgttatgagctaaaagcaacttaatgggtatttttcaaaaatcatttatgtcaattgctaatggacttcttttctatgccatgatcatgctttttttatttttgagacggagtttcactcttgttgcctgggctggagtgcaatggcgcggcctcagctcactgcaacctccgcctcctgggttcaagcgattctcctgcctcagctgggattacaggcatgtgccaccgtgccagctaattttgtatttttagtagagacagggtttcaccatgttggccaggctggtctcgaactcctgacctcagttgatctgcccaccttggcctcccaaagtgctgggattacagacgtgagccactgcgcctggcctgatcatgcttttaaggtggttgagtaagtactagttgctggggctttacttagtgccctcctactcaaatgtgttagaacatagttaagaaggctgtagtgttcaaaaggagtaaaaagcagtgcagtgtttgcagtaatatctgcttctcaatttaggactgatgcttattatggcttaaatgtttttgtagtaaaatttgtattcaaaaaatatatttttttttctttttgcgacagagtcttgctttgtcacccaggctggagtgtggtggtatgatcatggctgactgcagccctgaccttccgggctcaagtgatctttccacctcagcctcccaattacttgggaccaccagcatgcttggccgattttttttttttttttttttttgtagaagcaaggtttccctatgttgccaaggctggtcttgaactttagggctcatgtgatactcctgcctcggcctcccaaagtgttaggattacaagcctgagccaccatggccggccaaaatattttcactataacaaatatcatatctgtatatactcagttttaatactaactcaaagtagaaacataaagctgaatgactattttattttcagattctctccattgagtttccttctccgtcttgtgtgatctctgaacttttctccatctttgccacttcttgtctagcattttttttttatcagcagtttcattcagattttttttttagttctttcaacggtggagtggaagtaggcagcaggacagaagaacttgaagcagagcacactggagaggagaaattaacaaagcctttatgaataaaacaaccccccaatatcagtctgtgtgcattatgagcataattgtactttcatctcatctgtaatgttcatgacttttctagaaaattatactttaacatgagaaaagaaaaagaaccagctaattcatagggatggaggacacagcatagtcaaagcaagaatgaaactctctttagtgccacctccagtgcagaataagtaacattcagcagaggcaggtttcatttgataatggattcctataataaactgcgctcagaatttgtgcaggttttaaaatcccgtattccaaacccacttccttagcccccaagttagaaaacagcttcagtaaagaaaattgtacgatgatataactttaccaaaaaataatttctttccatgaagatgatatattattgttgacttctaattcaatcaaatataaacaattgctaaatggcttttcagttgactcctttcttggttaaggagaagataggaaaaaatgaagggatcagaagtcataggatacattaattttttttatctctgaataaacaggttgcctacttaaaaatctatcagtttaaaagtgttggtctcttctctctcttttcagaaagtgccaggaaaaaacaagaaggtatcgttggcagttctcgggtgtgttttgcacagcacaccccatctcttccagcagaaagtcctcggccattgaagcttcgaagcattcttgacatgagcccttttacagtgacagaccacaccccaatggagatcgtggtggatattttccgaaagctgggactgaggcagtgccttgtaactcacaatgggtaagtctggtaccacaggaatcagttcacttgctagaatataggatcctttttagtggaatctatatagttattaggggagcatgtgagtcagctcccaggtgggaaagtctgtcctatggtatagtcacaaatataggatcagtcaatcaaatttcacatttactaaggaataagaaagatgtcatctgcctgctctttgccaaacagtgacatttgtaaataatacctcaaagttggaaaagaggtgctgaaagatctccagcatgaaagcatgttgagcttagagtgcttcttttcctagggaagagtggacctaacctgcatggagcactgcaaaaacctgttttatttttgtaaatgtttcatttttagtatataaatttctagtacaataataagtttctagatattttgctatttactctttcagccaatatttgatttatcatgtaatgaaggaaagaatatatacttaaatgaaatttgtaaatgagctaaaaatctcctttaacaaatgctttgtttccttttgtctacctttctctatacacaaatcttttatatttatataactgctaaggacaaataaatactcatgtatttaaaatgtatacattgataatttatttttccaccttttacacatgaactgccagtgtttctccattgacaggaatataggaaagaaacagatgtcacgggggttgtggagaccttaatgcacagaattgatttagcaaatacactacttcgtcaccactgctctcttttcctggacctgggatctgtttctccacacttctttctttaggacccttcatttccactatatattctttcttgttgaacttaagaatgttgttttatccgaaggcaaataccaaaaaacagagggtattcttggattatgcataaactggatggctaatcctgaacagcgtaaagctggttgaaattctaaacagagaatcatagcagttttttgttgttttttttttttaacatgttgtagaaaacacattggtgacagaatacatgactcctgtccagagaaaggagagaaaaagaacagaaaggaaggaaatttgtttattgaacaccttcatattttctcatttaactttgcaggacctctgcaaagtaggtagttatagccctactttacagatgtagtaattaaagctcaagaagctttaataatttgcccaaagtcatgtggtgaacaagtcatggttcaaggaatcagactgtctttcctactttaaaacccagcctcttgctactattttgcactgtaagtgactgatagaaatcctctttctttgtgatttcttaaactactaaaacattttcttggccaatatattagattgagttaagaatagaaatatgaaactagagaattagatctatgtttagtgtttttcactgcgctaattaaaataactctttaggaatatgaagtaaatcattaaagagataaagcccttaaaggcagggagtttagaattattaaattctaataatttagatactgattggagaagagatgtattcataagttattattgttactatttgtctttgtgtaatattgtttgattaaatgatggcaccgacttcattaagtttaaaaactcagtactagttaaatggggcaacttttcataaagctttgctagtccttgagcccttttatttgttaaatggctcaactggaacctaagctgagttgttacaaactattatttgcttcaagttgttttctgttcctggcatggctttttcttttgtgtactgacaaatataaatgttattctgttgagttatggttaactatgaacacagaactgttagggattaattttcatatttcagtttgttgattaattcccaggtatttggcagcatagatattagaaaggaaaatatttaaaagaaagtgtaaaaataacgaagtgtatagagcgaggggtggatagctaattaaaattttgtctggtcctgcctgttcatatgaaaaaaggggttggactttcttctaagggaatatattaaattgctttcatcatattttccttatttctgtctgtcaaggaaaataaattgatacatatatggggagaaaagagatcatttagggaagtggctcatgggactttttgttttgtttgaagtgtattaggaagtcgggtgttttttttctcacttaaattatttaaaacccagaaaagaaatgatatcttctggtttttaaaggagaccatgaagttctgcatagctatcattgatgtgtagttcatactgcatttttagaagtggaaaatagttatttggaggaagataacaaatctggaaccttaggtgcaaggagaaaaagaatagatgaaagggaaagatgtttgtaaattataaaaatttcaattagctattggttttctgcactttatattttaactgcagaatttttcaaaatcagttaatcttggtggaattagcaggatgttaataggagtgactcagaaaaaacattttgtgactgtctaagtttggaaagtattggattaaatacaattgaggtttctttactatggaactcctcagaacttataatatgttgatattctttgattcccagatgaggggatgggtaataggatacatggttttccagacttgtttgaaaatgcaactatttttgggttgcagggaaggatatagtagaactcatgggaactggtgtttcttggaacatgctttggaaatgctgggttatgccctgttaactcttacatcattagtttttagcccaaaaggaaacagcaaataatgttttatatgagccacattttgcgttgattttccttccactctgtaaaattactaaagcagcactctgactttattatgctcaaatcgctcttctccattaatgtgtgtttctccatcttttagggtttttactttataaatacagagattactgtgtaaaattctaaatttgccactgggtcgttatacatttgtaaccttcctcacagtatattttgtgatttggcagagtttaccaatatagatgatactaactgaaattaatcattctgtataattggatagaaaagcatgagtaagaattcaattggtattatatttaattaattgccaagattttcacatttcctgactacaacaataaaatcaaatgaattgatggcttaaaaaaaagaaatctcaaatgtttagtcaatgaagaacatctattgaatgagtgaatgttcattatatatagtgcattttctgagcttttttggagggggaagttgctcccatgctctgagaacttttaaggatcgatacattatttttaacataataatgagaaaacatgagcagagaacccatttctgtcattcccattctctatcctcctgctcccccacctcccaccccagccatcaagctaagtaactattttacacctggacgtagctataggaacaggctactttgaagtctcctagtgacatccttcaagtctgaatgttcaaaggcagtttaacagggaggttgacttaatgagatcatcaaggaaatgtccagtcatcctgaagggtattttggatgggcttccagaatttaaagattaaagtttttttaaggtttttttattttcactgtttatattgccacattaatttccattataaaaccagtaaccatagttttgttttaattagcaatctaattattttcatgtatcctcattatgagaatttatgtccatcactttgcttgatgtgataacagtgacatgctaaatgagaaacaattgttatttagaaaaaaatgcacaaagtgaaagtccttttaatccctaatcataaatacattttattagcttactttaagaagtggcagtcacagctcctgaacattagggagtgtttcttttggtcagcattatttatttagtgcacattgcctttaattttaatttgaaattatagtaaaatccacgggagtttttaagtctcctcacagccttttgctaccttttcaccaaggtagatccagatgataactgctgtgttgtgacatcatagaaattagaaaaatattttcctctgaggaaagaacattgtaaatgaaactctacatatcagaggtctatagctatgtatcaatattaagtttcttttgtactttgctttgtagtcatcttcattccaaactttcataattattatttttactttaaaaagaaaaataacccaccaatattgaagattagtattgtgtcacttttgaaagtcagtagaatttatgcaaaaggaacctggaactttaaatcattttgtttttattttctaaagttcatgagactcattcttatggttcatgtttttattttttctctcattctttatcattatgattggaaactcttttaatttaatttctcacacagttattagcataataatctgtttcaggattgtcttggggatcatcacaaagaagaacatattagagcatctcgagcaactaaagcagcacgtcgaacccttggtgattagatatatcagatctcctcattagacaccttagaagtcaggaagcatgaaacttgtgaactgttgagttctgtctttcccagatatctgctgaacaaaaatatcctactatgctgccaattacatttgtatctgataaaatgtgtctgtaagataaatttagatatgtgtaaaatcccatttatagaaagtaagcaaaagttaacatctctcatcaaatcattcattacaatttcagaactgtaaacagtttggtagtggaataagtgaatattattggacattcttaaagtgaatatggcaaatctgtctacctcagtggatacaccggtctcagaagacacctgactggttaaaaatgtctgacccatccccgcaagcccttttttttttttttaaatgtttcccgatcttgtggtagtcttatggtaaatctaagctcctaaaggattttaaaggagcttagcaattagaactgcttacagttaaatggattttttaatgggcacactaactagagtgtaatgtgtatattatttgtgatcatagcattagttctttttctgctataccctgcatatcttcaaagtcacagtgtgtgtcctgccatctcattagtgaattgtacctagattatgtgtgtgccccttttgtatgatgtttctggaacgctataagcagcttttagagtcaaatgcattcattttaactggctttatgtcctagtggtttcatgactacaaatttgaattatcttactgcataacataaaaaatgtctggctttagcaattaatgcccgaaattattttgccctgcaattgtcatacctgtatgaaacctgtcccagtttgcttaagtgcacaactgattatgtattcctgtgtgtatgctaatatttcacaagtgtttcatgcatccttttttaaaaaactactaaccagaatattatcgtagctactcattcattctgctttctgcttcacctataataatcttttaggactgccttctgatttttcacctatcttttaatgtaagcattaacaactaagactttcataaaagcactgtatcttaactttcctggcctaaatcaaaaaaaggaaaacattgataagtgtcctagaaacttggattcttttatagatttgttcttggggctctgatgtttgggattgacgttctgtgctgaccattttatatgcattttatcttaatagtatgtgctttcatgaagattctgatacaagtgggcaatccttaaattatctttgaaaaattggttaattttggttaaaaaagggaaagtggctgggtgcagtggctcacgcctgtaatccccagcactttgggaggccgggacgggtggatcacaaggtcaggagttgaagcccattctggccaacatggtgaaaccctgtctctactgaaaataattggggcatggtggcacatgcctgtaatcccagctacttgggaagctgaggcaggagaattgcttgaaccggggacccaggaggcggaggttgcagtgagctgagatcgcgccactgcactccagcctgggctacagagcgagactctgtctcaaaaaataaataaataaataaatgaaaaagagaaaatattgagaggatttggtcatcattttactgctctcttcatgtgatggaaatcaattttccttctcaaatgggatcagtatcatttcctagtcatacatccatccagtttttgttacttttttgttggcatacattaatcaaaatagctctgcttcattgaggcatgcagtcctcagactctcggtggaaaggctgtcatactattagtgaccatagtaactttttataccaaaggatggttgctggataattttaatatctttaccaataaagtactttttggaaatacaaaatcaggctgcttgctttgctctattcctgtcaacaaaaaggatttagctatagatttagcttctccttttattttcccttttatttcataggagtcttctgtttattcctttcaggcgcctccttggcattataacaaaaaaagatatcctccggcatatggcccagacggcaaaccaagaccccgcttcaataatgttcaactgaatctcacagatgaggagagagaagaaacggaagaggaagtttatttgttgaatagcacaactctttaacctgagggagtcatctacttttttttcctcctttacaaaaaaagaaaggaaatataaaagccgggtttttgcaacatggtttgcaaataatgctggtggaatggaggagttgtttggggagggaaaggagagagaaggaaaggagtgaggtatttcccgtctaacagaaagcagcgtatcaactcctattgttctgcactggatgcattcagctgaggatgtgcctgatagtgcaggcttgcgcctcaacagagatgacagcagagtcctcgagcacctggcctgttgctccaacattgcaaagacacattatcagtccctatttctagagggattactttgaattgagccatctataaaactgcaaggtcttgcccttttttttaatcaaaactgttctgtttaattcatgaattgtatagttaagcattacctttctacattccagaagagcctttatttctctctctctctctctctctctctctctctctactgagctgtaacaaagcctctttaaatcggtgtatccttttgaagcagtcctttctcatattgagatgtactgtgattttactgaggtttcatcacaagaagggagtgtttcttgtgccattaaccatgtagtttgtaccatcactaaatgcttggaacagtacacatgcaccacaacaaaggctcatcaaacaggtaaagtctcgaaggaagcgagaacgaaatctctcattgtgtgccgtgtggctcaaaaccgaaaacaatgaagcttggttttaaaggataaagttttcttttttgttttcctctcagactttatggataatgtgaccgggtcttatgcaaattttctatttctaaaactactactatgatatacaagtgctgttgagcataattaaataaaatgctgctgctttgacagtaaagagaaggaagtattctgattagctgtatctggtattaattgcatgttaaaacactggaatttttaaaattgaaattagatcagtcattcttttcttttctcaagatatctcatggctgacactgaagaagaaatgtaattcataacttgcactaaatgtatattttttttcttaaaaatttaccattcttatttatatttttatggattaaaatttataaaatacagatcagttaatattgcacttaagtaattttacctttttaatgtgatttttatagaataattcagacttacaaatacagagatatgaacaaagtttacagtgggaacaaaggtttaaaaaaaggttgtggttctctctctgtgatccagtgtgcacataaacctttctctgatctttcactgccatcctctggattatgtcttctgacctgtccattttgacccattaactggaaagttgaaaaactacattaactggaaagttgaaaaactacattactttggagaataaaaccgaaagttcgtgtataccttcttaaaaaaaaaatcaaaccaaaaatgtgaaaacaatagaattgcaaagatagcagttaaaattttaatctgaaaataacctttgaatctcgggctaggttacgtccatatttgaagtggtcagtgatggtttgaacattttttgcaggatgagtgaaaatgcactggattatatttgggatttttgtttttggaattgtctgttttaatcacagccttaattcacaattggcaaaggcagtttactcaaaggactgggctaaatattctgtaattatgcatttttgataggaaaatgaaatttttgcaaacagacattttctttttttttggctggagtgcagtggggcatggtcttggctcactgcagcgttgaccacctgggctcaagtgatactcccgcctcagccacccaagtagctggcactacgggcacacgccaccatgcccagctaatttttttgtatttttagtagagatggggttttgccatgctgcccaggctggtctcaactcctcagctcaagcaatctgcctgcgtgagcctcccaaagtggtggaattacaggcgtgggccactgcgcctggcccagacagacattttctgaaacacaactggcaatgagctgtttttacattttgaaagtgattcttcacttcctagttcttaattatagtatacctattaagatctgtaagatcctgaagacataagatcatgaagccatataagaatgaggattgaaagttgagcaaaattttcgggattttgggaaacattcttagctgtgctatctgcctaaaattattccttattacttctctcctttgacagacttcaagttttcttcatagccctttcaaagttttttgagccatccagagtaaaatcatttctaaatgatagttctgtatatctccaactcgtcttaagtgtatttgcctgtgtgcaacgtattgctagactatgaactcctcagcatggctgctggataacttaattgtcctgagttaatagccttcaaaggacaaatcggtttctttgcagatagcttcgtaaaacttcacatggagtttattttatcatatttcccttttttatttctgctcctcctttaattgcccatcttgcttcagagactgacatttcagggtggatattaattaaagcattaattttgttttttggtatatttctatccctagtatttctatcttactgctaaaatacaggaaaagtgccgtatttttaatgcatttagtggttttctttggtgttatctgttccatttttctttttcatacattgaagtgtgtctccttttcaaccaaaataatgaaatagtggagaccatgaaattgttgtgcctggctaattggcaaattaatttaccaatataataagtgtagcgccttgtttgaataccctttttgagaaggtatgatgagaatgggcaagggtgtcagcatctcttcttcttaataattaattgttttcagttttggttcacgaagaatgcttagttaatctgtaatgttgcctagagctgtatttatctgtttttatttatactagtgtagtaaagctgcatatcattacagtaaaaacgactactgtgatgagttaatcagaaaatctattaaaatctatatgacaatgtgtggtttggcctttaattatatctgtaacagtcctccctcttcactgctgccctacgcagtgtaggccgatatgcctggcacagggagccccaaaaaggtaataattataatgcttctctcaggttacaaagcatttctacactttgcaagcaaggagcaatagaagagtagatagatgctggattgacagcaggatgttcataccaccagcaatggtttagcgcccccatttgtcagtgaaagctgcaggtccacagaaaactgatttcatttcagctcactttcaaaagtgatttttttttttttcgcaagaaaaattacgctatttgcatgaaaagaggtaaaacgatttatttacatgtctttaaaaaatcaccttggacatttgctaatagaactgccaaaagagggtggtaagtaacaacctttgattaagatgtggtcttttactattaagcttttagtaaaaaggaacacactaaaagttcagagtagatcatttatattcactgagtatttactgagcaattactgggcgccaggcgctattctatgttcttgaagttttcattccagcaggaagagaaatctagagtatgtcagatggtgataaatatggattagttcagcaattttaaaaaaggatttttatgtactgcacactgttacgaatatacaaaatcagtcaagaatcctgttatagtttttgtaatgtacaaaaagtgaaggtgtgtgcacccaccccatttttatagagggtgatcagggaaagcctcagggataaggaagcatttgagcagaaacctacagaaagttagagaaggacatttatccgtgagaaaaaatgttgtaagaagagaaaatgctatatacaaaggattctcctgccaggttcaaggaacactgagtagatcactgtggctggagagggataagagggaagaaagtggtaaggaaagaggttgggggtgtaggcatttgatttttattctaaatgagaagccagtgaggcagaaaagtcacataatgtgacctaaaatatctctcagactcctttgttgggaatagactataagggggcaggggtggaagcaggctaccagctagaaggctcttggaataattcaggtgagatgtggtagagatctgaacctgattgaagctggtggaggtggtgaaagcagttggattcgagacatgctgaaggtagaatggacaggacttgtgaatgggttggatgtagtgtggtaagtgaggagtcaaggatgcctgcaaagtttttggctgagtaatgacagaacaatggaatggccactggctgagttgggaaagacttaagaatagattgggggtggggtgctgtgtgcagaggaattttggttttagacattgttttaaatgtcttttagacttccaagtgggggtgtcacataggcattagcatgtatcagactcgagttcaggagaaaggcccagcctgagagctacacaggggcggcatcatcctgagacaggagagtaccgtgcattgaatgcagacagagaagaggtacaaggaccgagcactgacacatgcttatgtttagatttggggaggtgaggagccagcaaatgagggagctgccagtatggttgggttaggagtagtgaccttcaaagaagggtattccactggtggatatattaaaaaataagctgcgtgtggtagctcaggcctgtagcacttcaagatgccaaggcggggcagcagcatctgagcccaggagctcatgactagcgtgggaaagagactaggtctcctctacaaaaaattaagaaataaaaatatgaactgggcatggtagcacatgcctgtagtcctggctacttaggaggctaaggcaggaggatcacttgagcccaggagttggaggctgcagtgagctaagatggtgctactgcactccagcctgggtgacagagcaagaccctgtctcaaaaagcaagggtagtcccctaaaccaaatgaataatagtttcaaggagcgatgattaactgtcccgtgttgctgataggtgaagtaaatgagggctcaaaatggaccaataaagagagaactgataacttcccccagagtaggttcagcgcgatggtggcaagccaaagcctgaaaggagtgggtccaacagagatttgaagaattgaagacaacgattccaattcttcctatcaggtttccaggaaagtaatacgtgatagttttaagatgcaggatattatagcttcttttcctgttgatggtttgacagggaaaattaatcagaacattcgggttttaagatgcaggaaattatagcctttttgttaatgataggaatgtttgagaggaaaaatagaggagaggacctcgagtaggcaagggaggatggggtcttgggcacacattcaaccttccttgggtagttggtagggcagtgggattctgttaaagttattttggtggcttctattttctcagtgaaataaactgaggatgagggtgggggttgggggttgagagatgagaaagtaggatcgatgggcatccagtgtggccaacttgaggttaaaataagacaagctgccatggttgtgttttttctccagctacctgatactgagcagactctggtaaggaataggcagttttaaaaatctgccttaaggttaacagataaatacaacaaatggagagaagggcagtggagtggaggatgcgggggtgattgtaatgatggggagtagaatctaaaggctcggtaaagagagaatcaggaatggagtgggtgaagaatgaaaaaggtggttacatttgtgaattgtaggggactgtcgtgttgaaaaaatttttggggtactagagggaaagagatggaaggatgagtgatgatgttaagacagtaggatgcttgagattgagatttgggaggttttcattattggtactgagaaggtactagtttctagtttgtcaatcaatccctaatctagatcattgaaagagtaagtcagggaactgagaggttagagtattgtagggatcacctacatatatatatacatacatgtatgtatatatataattttttttttttttttttgagacagagtctcactccatcgcccaggctggagtgcagtggcacgatcttggctcactgcaacctctgcctcctgggcttaagcagtcctcccaccttagcctcctgagtagctgggaccacaggtgtgcaccaccatgcctggctaatcttttctatttttagtagagatggagtttcaccatgttgcccaagctggtctcgaactcctggccttaagctgtctgcccaccttggcctcccgaagtgctgggattacagctgtgagccaccgtgtccagccagacattaaaattaattatgataggaatagtttggacagaatgccattaagctggtaaggtcagtgtttgaggtaatgcaaaggtcttaggacactgcagattagtttatagcaatctgttttgcagctttcatttttccttgggtgttattctacatacatgtttgagaggttatacagaaactccattattgaactccaagaggtgagcttagctaaatgtgaactggtaatgattttctgttaagtcctgattggatcaaggttcttcattcatgaaagagcctaggcacttaaactgtgttctcagagaacagaggtatatagatgccatttggaagctactatagcaattgagtgaccagatcctaggtaatatttagtgaactaggtttaagtggactatgcctttagttaaggaaaaagataaaatttggtatcttcctgtagggagcttgctctttaatgaaaaatgttcagtagttggaagatagtacctcctgaaacaggttagtagcactctgacacaactggttggagtttgagactggaaatccacatttcttattactgtcttcaggaaactccattcacaactgtatcatctgaattataaccaccatattcttagagtttgtgtccaatttctgtcttggctctgatgtgcccagcttcctgaagatacattcatattaggtttctgtaaggaatggatgaaaagccgattcaccttttttgtcccctttcatttgttccttgataaaaaatccttctggaatccatattactgataaagcatataaaaaaaaaatcttacaaactatacagttgagactgttggatcaccaagtgacaaaattaaaggaatctaatgtttctagctaaacaaatatttaatgagatacatgaatttggatattttttaagtgtgttaacattaggggcagtatttagaaatggttgagcccgttagaaactaaagaaatctgaggaacaaagctcgaacttctaacattttatttaaaatttatagcctaaaatcatttaagatcaatgtgatttggtcactttttctaataaaatatgtgtgagctaactgtaactgtaatgttttaatataaaacaagttaatagttcagatggttccagggcctggagctacttacctaactaaaatggcagttccttaaaacctaagacctccccattaagagctgtaaaagttcctgcacagttatgaaagggaagctgaagatcttttcagtttcattttggttaagatattatacaaaatatacctaccttgaagaaagcatcttacctgcctccaaaggcaacatgagccattggcagaaaggaacagattttgtttgtggcagagatttttgaccccagaagactttttgtctgagaagtcaagaatccttaactcccaggcatcttatcagtttcccagctcttgccagtttgattctgtctagcattgaagaacatgtgacagggtcattttattcacaaagtgcaattccaaaggtttgtgttactgagggggatatacatccataaaatacatgcccttaagaagcttgcagcctaattggggagatgaggaatgctacttatatttaaaattctaagtgttgtcttttaatagtttactcatacccttatataaaaaagagtaagtacctgaaatatattttaaggggacagctgacagaactttggagaactactgtctagtcaataagttatttgagtaaatcacatcaattttacacaatgtggaggtttaactagatgacctgggatggggggacggtgcttttccatgttgaacttcatagaaaggggaaaaaagcttatacactcctcagccccatccaggaagtttgctattctgcatttcatggtctgccctctacctattttttttttttttttttttggagacggagtctcgctcttgttgcccaggccggtgtgcaatggctatctactgcaacctccacctgagttcaagcgactctcctgcctcagcctcccaagtagctgggattacaggcgcctgccatcacacccagctaattttgtatatttagtagagatggggtttcaccacgttggccaggctgctcatgaactccagacctcaggtgatccgcccacctcagcctcccaaagtgctggggttacaggcgtgagccaccacgcccggccctgccctctacttttaaggtgaaggacatgtaatcaggtttaaggaaaatctggatctagtaaaacacagctatccacagattcgtactaaacatccattgaaatcatttgcaatgaaaaactttaaaatctaaagtaatggtatactgattactatcttatactaaaactatatactatgtatcaatatactagactgtattagtaaatgactgagtcaagagaagatttaaaataatatacctaatgggataactggactacttactgggagtcacctggagctactactcaaaatgcagtttgggtaggtcggggtcaggcaccctggaagagtgcttattgcagtgtcatgagtctccttctaagtttccttctgttcccctcttctcctgccataaacccgatccttaaagctacagctattaactcaagactcagaagaaatattcttagttgcccatatgataaatattgaaacaggactctgtaaggatggtctagttatagccacaggcattagacagtggcttcctgtgacatatcagagggtgactttaattgtcctccaaaatgtgattagggtcaccatttaggtgatttgactgccatttttttgcacattaaagaaggaaaaccaggcagaagaaccttataaacgtttttagtaaatgtttattttttgtattccttaaaaacaaaacaaaaatcacaagtttaatactagtcctttgaaatactgtacaccaatcaaagccaccttactcatgcagcaagttggtctatgttctcttgacttctgtttgccagatgctcctcaataatttctgcaaacagattcctcttcaacagattatatgcaagaggtaaaagctggccagcaactttatgaaaatactgaaaaataaaaatataacattaagcagagaatatagcagatatcctaataagtagcagaaaatatatcaacaaagcacttgtttaacaaaggctacttccaaaatcattttagctacaccctcaggtggttagtgaacataatttaaggacaggcgcctggcattctaagaggcagtcttgttgctctagatgactaatggcatatcttgaaaattaagaaaaccaaattaaatcgagcttccttattcccttaggttttatcaactttttctcaccccaaacaatgcccacaaatactttttattctctccagtgtattcccaggcaaaagtttaagctttattttcctcaattctgtaagaatagctatgctgaaagttttcagatcgtattgcctttatcctcaaattccttctctcccccatccccaacacgtaccgcctcccaatccctgttaagagtcactgccttaggcttatcaaaagatttgagattactgctattatctacatataccaccgttttgctgatcataataaacatttagcccttaacatgcggtaagcactgtgctaaacctttttataactcatacatgttatttcattctcacaacaagcaagtttgctattcactggttcacatcttatggctctacttatttatggctagggcctctctagcaggtcaagtactatttggattggtcaatgactgtcattctggctgttaagcattttgattatttttactgataactatctatgaggtgggcaaagaaaagtagtataatatggtttatagcagggttctcaaaatgtacacccccgaccaggagcatcaacttcacttggcaacttgttggaaatgcaaattctcaggacccaccctagaactcaatcaaacttggggagggtgggaagactgccagtgagcgtttggacaagccttcccattgacgctgatgcacgctaaagctggagagctactggtttggtcttgcttttcccagtgtggtctgtagagcagcagcatgaccgtcacctgggagcatgacagatatgcagtctcagatctcatgctggacctaccgatagagtgcattttaacaatgtctgcaggtgagtcatatgcattttagtttgggaattactgcactgatttaggcactgattctggagccagactgcttgtgtgaacctgggcaagatgctttgcctctctgtgacttggttacaaagtaggttaaatgagaattaaatgatctgcgtgtgggtatgcactcgtgcacatgtgcacacatatcttacaggtaaagaaacagatgcaaaggtgttggaaagcttgcccgatcttacacactgggaagatgtgatttacaaccagtttggccccagaaacaggtcatatccgctacaccttattgcctctttgatcttcaggcaactatggtcgagtaagcactggtttagctattaagtaaaattttcttatttaatgagcaattagttaacggtaaaacagcatctcttataaagcttaaataatttaaagtgcatttttcatctaagaatttaagcacaataacaaatacccccaccacaatggaaacgaaatggagcctaaggtgtgtgcacacacccccatacctagccccaaacgtacacacacggcaagaaggcatgtccctataatgtgtctaatgagtaaattcactttaatgtaagcctgaatgcaaataatcttcacctttgagtgaatgcaaatattcacctttgccagaatataagatgagtttaaaacatttttaggacatctacgttaaaaaaaatcacttcaaaaacttcattttgaaatacaagctgaatccctgtcttacctctgctggaatttgggggtataaatgtgcacgtattcatgtgtggatgtatgtcgcggggagaggagggaggtgtggcagtgggtagaaggtggagggtttttttactcacatgtgagccatagcaaaagagatccattcccaattcaagccccatgccataatcacattcatcattagcaaactgcacaaaagtcatcatttcctgaatgggagcaaaagcttttagtctctcctcatcacttgcagcctcaactattgtcttgcaaattctcttgaggtcagctgaaagaaatcaataatataaaagattatctacatagttagaaaatgaatcagtcttcaaaagtaagaagattataaagagggtttttcctcctaagactttgtactaatacaacttgtgccaccttgggtagtagtcttcagcactctaatttagaatggcaatttggtaacttttctacttaggattcaagcttaaaaacaggttaacaagtatttctttattaacgactatttcacaggatttagttacagtcacgatttttttttttttttttttttttagacggagtcttgctctgtcaccaggctggaaagcagtggtgcgatctcagctcactgcaacctctgcctcccaggttcaagcaattctcctgccccagcctcccaagtagctggcactacaggcacatgccaccacgcccagctaatatttgtatttttagtagagacgggatttcaccatgttggccaggatggtcttgatctcttgacctcatgatctgcctgcctcggcctcccaaagtgctgggattacaggcgtgagccactgggcccagatacagtcatgatttttttaaaaagtctattccatggtggtcatcatgcatttacataagctttaaagattcagcagactagtccaggagttggcaaactttgggcaaacctggctcaccctgtgtttaactgccctcaaactaagtttttttcatttttaaatggttgaaaaatcaaacaagaatgtgatagattatgtagcccacaaagtgtaaaacatttactatctggctgtacatggaaagtctgccagcctggttcatgcactatatagttgcctctgtatctgagggttctacatccttcgattaaaccaagtgcggattgaaatactcaggaaaaaaataaaacatacggattttaaaaatacagtataacaactatttacatagtgtctactttatattaggtattctaagtaatctagaaatgatttgaaatatacaggaggatgtgcgtaagttatgcaaattctacaccaacttatttgagggacttgagcatcagattctgggtatccttcgaggtcctgatactaagacaactggattaaaaaataatccaagtaggcaaaatttattctttttgccctgtcctaccttgtttgctaaaaaaaattactgacttgtgacttgtggtgaactaaacccagaaaaagacaacaatgtaagagacaagaaatcactgcagaattaaacctttaactaaaaccttcaccaaattgggagaagagtaggcatggcaagcatgcgtttgaggtaagaatagagagaaaatgtctaatatttacctaaagaatatatttttacaaattaacatttcaattttggctttcaagatttttttcattctttctggatgttaatgtacatccgatttcaggacgcaaatgagatggaagtatgaacaatatctatttagacttccttttgacaaattgtatgtcctttttaacaaacagtacttctttgagaatgaaaagaatggatattattcaaacaaaccaacaaaacatttccaaacaggtggctgccatactgggggagaggaagactggttaaaacattaacaattatactcaagaatgataggtgatgttaaattctatgtatgaggcacaacgttctgatgagactaacgaaaaatatcaggtatgatattaccagggacgggctgagcgcagtggctcacgcctgtaatcctagtgggaggatttgggaggctgaggcaggaggactgcttgaacccaggaattggagaccagcctgggcaatgtggtgagaccctgtctctacaaaaaatagagaaattagctggacttggtggtggacacctgtagtcccagctacttgggaggctgaggtgggaggatcacccagtgcaggaggtgcaggctgcagtgagccgtggtcatgccactgcactccagcctgggtgacagagtaagaccctgtctcaaaaaaaaaaaaaaaaaaattaccaaggatggtattaaaaatatactatatactagtgcttttaaccccagtctatgaataacatttggttcagtcttgacgacagtacagaatacatgctgttaccccagtcacaaaatgtgttgttccctttcccacttttggtggaccagtatcgcattgaacgaatggcaaactgcaccacctacgtttctaactatctataaacagtagtgacatatttgttggtttgaaaccttttacaaattaaattattttacatgagcttcatgacattcctttcttcagaaaaatcagtgctgatcatttcaagaaaacagatgaagctttctccaaaaagctccttaaggatggaaaataagtggttcctccctgttatcgtgggtgtaactgattgactgggacccttagaatctctctcgctgtgctccagtcagccactacaaatcagggtgggtatggaagtgaagaatttaaagtttatcgctttccagtatcttattttctatttttacacctggcaagtcacatatggactaaaaagaataagcaacttatgcgaattactaagctagaaaaacactgaagaacagagatgaaaatattcagctcaccatcagtacaaggaaaaatatgttcttccagcaataaaacattctacagaaatttcatttaactgaaacccaaacttaaagaacatgagtgaagccttaagttaactattcaaaaatgatgacttaaatgtttctactcaaaatactcaatttaatgagttaggagtttcactgctgaattcttactatatccctgccactactatcaactagaatacttaaattaagctacagtagttctgtcaaggtaaaaatcaggcaactaggcaggcaactcttcttacttcggatagtagtatgcactctacagtcagaaaaccaagtatgaaaaccagtgccctcagccggggctttgggaagccaaggcaggtagataacttgaggtcaggagttcgagaccagcctgatcaacatggttgaaaccctgtctctactaaaaatacaaaaattagctgggcatggtggtgggtgcctgtaatcccagctactcaggaggctgaggcaggagaatcacttgaacctgggaggcggaggttacagtgagctgacaccctaccattgcactccggcctgggtgacaagagcaaaattccatctcaaaaaaaaaaaaaaagaagaaagaaagaaaaaaagaaaaccagagcccttactgactaatgctaagcaccgtgagtctatttcctttgtgaacatgggaataagacctacaataaagagttgggtgagaattaaatacatcacttgttaaagtgaatcatgacactgacatttaagaattgctcaataaaacgtatcttatttgctaagttaaagcgttattgtgagaagcttcaaagggttaagaacaaacttagttgtgatttgctaatcattgtcacattaacaaactgccagtcagttatacctcttggcaaatgacactggcaagagcaagaagattaggtccttcagtcttaatgttttgctaccacttcaaaactaattaaatacagaaggatctaatgcctagaatagtagacttggatataaaaccccagaaccacaactaccgcagggtaacaggctttactccagggcactacaatttaacatccatcaccccaaaagctttagagactgcccatctctacaacaaatgtgcgcaacctttcccaaacgagatagtaatcatgctttttaaagctctctctgtgagcagagacatgaagagaagatgacttagtgtagaagcagaagactgaccagtagctagggcccacaatggtcccatcagagactaattgactctggcttcaaagaggagatataggacagatcagcctgtctaagagaaatacagtgtgggttacattttttccagtatccacatgaaaaaagaaacaggtggggcaggagaaggagctaaaaaaaaaaaaaaaaaccaacaacaaaaaacaggtgaaattaagatattttatttaacccatatttccaaaatagtattatgtcaacatataatcaatgtaagaaacatttaatcctgttttaatttacaaacttaaactaattaaaattatagaaaattacaggccaggttcggtggctcatgcctataatcccaaaactttgggaagccgaggtgggttgatcacgtgagcccaggagttcgagaccagcatcggcaacagagtgagaccccgtctctacaggacaaaaacaaaaacaaaaacaaaacccaccaattagccaggcatggtggtgcacacctgtagtcccagctactcgggaggccgagacaggttaattgcaccactgcgctccgtcctgggtgacagagtgagaccctgtcacaaaaaaaaaaaaaaaaagaagtaaaaaataaatacgagttacaaattttgttgcaggagccacctgtgaggcactcagtggccatcacactggacagctcagccacattcgtcttccctatggcactcctctaagtggcaggggtacagcaaaaacaggtccgtatgagtagctgccatctaagacatctctacctactggctggagactctgcacagtaaaatttgagaagaactgctttagagaattggtttaaatgcagatgtccaggtcacaacccccagagactggtaactaccaaggctagttagttctgttctgaaaagcagacggccaaatacgtgcattgggcaggaatatgtggttctttgagaagatgctaagtttgatttccctttaagttttatccccccagaagaggatgatcaataaaggaataccagcagggctgttcacgataagggaatggagacaaggggaaaagaattgagaagcgattttaattctcgatgtttaacgtagcaataactagattatgcgcagtggtccattttcaaagtgtttttatacttacagatgacgtagttcaggatcttgggcttctgaaagctaaatcattttataggcagatgaaaaaatgttcacaaagaaccataaaaacacaatttcaataattactactttgcaagttgactgtaatgtcaaaggttcggaaatagttcccaagaagcaggcaatgggttaaaattctgaaaccccgtctctactgaaaatacaaaaattagctgggcatggtggtgggtgcctataatcccagctacttgggaggctgaggcaggagaatcgcttgaacctgggaggcggaggttgcagtgagctgagattgcgccactgcactccagcctgggcgacagagcaacactccgtctcaaaaaaaaaaaaaaaaaacaaacaaaaaaagaaactactgaattttgaacactgaggcaagcattttgttaagtattttaatacttgtttacaccacaaattcctttatgaagtgcatatgattagctccattttacagatgaaaaagacaagatttcacagggttaaataatttgttcaaggccacacagctatgaactcggttttaattcaggaatgactgactctaaaacctcagcttactctttattactaaggtctagcgactgtgtcagaaaaggtatatagacatacctacttcccaatataagcaaaacctttattcatgtgcattaacatatatgcacatgtttactatgaaatacattaccatctgtttcagggagctctcggtacccaacatcatttttatctactggaacaaccaagcctgcaccatgaaaggtctttgtcacaacctacattaaagaaaagaataaaatgtaatcatggtaagcagacatcaaaaaaaaaaatccccaaatacataaaccctcaacatttctgccaaaatgtaacatttaatcacattttatttcagtaaatttggactccagggtaaaaatttaacactatttttttcttgaaaatcagctaaaagttaaacagttgaagtaatcacagaacagtgaaataattggcttttcttaattgtgccagtcacttggaagtctgcaccctgatttgttaaggaagaacccaatacatcctagaaggcaagtcaaaatattggtttcctctaaggtcaaagtaccttctggtagaaagcacagaggaacctggttctaaaagaaaaagagtaagaaatagttcttgtcagcaagaagatatggtaggacagaactcctctcatccatcctgccaaattgagactcccctatttttacctggaatatttaggcttctctgcaaacttcccaaaagtagggcagtttctaggtttgtggtgtcctttatggaggcaaatcacataaccagtgagcttttattaagtggtagtcttcaaagacaaaaacaggcccaactacaactaccaccataacccttccagtttccattcttcctttagctcatgttagtgacattatttttaggtctttccttagcgaaacatctgtacaaatattccacttctttgtgcaattcagtgaaaagtttccaaggcagaggaaggacacaacccaaaaaccaaactccaattttaaaggcctctcacctaagtctctatatcttaaagatttttttctctctaatctccctattctcccagtctcttgcttctttcattatcctttattaagctgccagaaagggcagattattcaaaggaagttatcagacaactgcttaccacttgggaaaaaaatgaagtcattgtcttctatcttaatctttctatcaagataatctgcagctggatttcagaattaaatgtaaaaataaaaccatacacatatacaccatggaatactatgcagccataaaaaaggatgagttcatgtcctttgtagggacatggatgaagctggaacccatcattctcagcaaactaccacaaggacaaaaaaccaaacactacatgttctcactcataggtgggaattgaacaatgagaacacttggacacagagtggggaacatcacacactggggcctgtggtggggtggggggaggagggagggatagcattaggagatatacctaatgtaaatgacgagttaatggatgcagcacaccaacatggcacatgtatacatatgtaacaaacctgcacgttgtgcacatgtaccctaaaatttaaagcataataaataaaaaataaagacataaaactactcgaaggtaaattttaaaaaataattttgtgatagagaagagttgactatataaaaataaaaagtctatccagtgaaatcaagtacacaagacaaattaactgataaaatatatctgcaaaatgtaatagtaaataaaaattaatgtctttaaactataagggagtctaacaaaggaaaagactaacatccaaattagaacacatgtaagaaaaagactaattctaaccctgatagagaaatgggcagagttcaggcagttaaaaaaaaaatacaatggccaacagagaaaagtatttaacgtcctttataattaaagaaatgctaattaaaactgcagaattttatacctaccagcatggaaaaaactaaaaagactaaagaaaaccccccaaaattagaaacaagcaaagaaaaactacaaacacacctacacacacacaaactactttggacctggcaatactacgtctaggaatttcttctaaaaaaataaccagataagtatgagaataaaggtataaaaggatatctatggcaggattgtgtttgtgaaaaatcttaagcaacccaaactttgaccataagcacagtattctgcagccgctcaaaattatgaggtagatcttaaattggcaatatgaaatgataaagataccatattcataagtgtaaaaagcaggacataaagcactgataatgaaagaaaaagacagcagtgctatagttgccagctcaggctgaacaacataaagaatgatggtaatatgttcagatttttcacagatgattacctgtactaattgtccatgaagaggaatcaattaagaagtcatcagaattgtaattttattaagaaattaagaagaataagattacaaatttaggaaagctgtataggggtgggtgacatcctgaagcatgggatcacaggtggatggagtgccacaccatcattttatgcatcatttaaccaacgttccttatgaagaaatccaggtatgaaaaaggtgaagtggcagagagccaattagtaagaagatggggtggaaagaatgctaaatatggaaaatatgaagttgggttttacatgtgtcatttaagattttggacaagacacaaaacctctataaccctcaatttactcatctataaaataggataattccaactttgcagatttgttgtagggagtcaaatgatataactcataaagactctgcattccaaagtatgctaagttactatcagtataaaaacactgatttctagtgtgctgcacagtgctctatcatactagagtggaaatatgcttacgctcacacacaaggacaaagccactaactcacatatactagtggaattgaattcttcagtagaaaaatatgaattcaatgaagatctcacaaaaacaataaaagaacaaccttgcatttaacagaaaagggtttgaaagtatagtcattaacaggggaggattaaaaacatgattgtcttgaaagttcttttttgtctttgtttttaccagctgtttttgtataaaaaacaaatactaaaatgaaacttcataggggaggggtctaggacaaaaatatctatgaaatttaaacctcaatcatatcttctttatggggaagaattaagaaaatctcctctgaaataaatcatagcttgtggtagaaaaataaaaaaagactgattaaataatttgctaacagctattatgtgtacggatgctcagactttagtcaaaacaaattagaaatacattaactaggttacaaatgctacccttcctcctagtcacaaagtggaagaagcttcctgtgataaccagaaaggtaaatggcaatataaaatcttaatatttaaaatgccatattgtaatgggtttcattaaaatgtatgttttaagaaactttccagtctataggactaaagagtgcctagaacttgatacaaatgtcacccctgcagctgaatcaagatcagagaaggaactgaagtaggatttaatgcctaagtacactaaggtacttcattaccagtgctagtttattaaggaatagcaagttctccatttagcttagaacattcagatgaaccagcatgggcagacaaatggtgagaggctggaggagactggggagccctcattccagtgacaaattttttttttgtttttgttttttccccagaggccataagaacaaactcctatagaattctcatttactccaaaccagaaatcttccagcttgtcattaacttactctgaaatctatagctgaaaaaccaaaagaatccaacattaacaagtatttgctcctttacaaaatactcccctcatattgcagacattaggagagatgcaaaaggaaatgataggattaataaggaaaaagaaaggagcactgcttatatacacgtttactggagaaaatgtatgtatgtaaatttcattatgtacaaagcagctttcacttaactttatgaagtgattaaatggtaaacaagattaaaagagtggtaaatactggcatgagttattcaaccacagcagtgatatcaccagttgcgcaattcaatcagtgtaccaacccaaaggagccatctgacccctgtttcagtgccatcctctttcagtgccatcctcctaacatccctaagggacagcatccagttcttaagataggactagggaagagaagggtaaagtagagatgggaaggaatcaagaggggaaaaaaatatgctatagcaaaacagagaccaacaggttgaaatcatactttcttatctctctgtttcatcttcacggttctctgttcaagcgagtaccccaattctctggctgcttctgtgagtttttcatctatgtttttcaagagattgattttctttttatccgttatttctctaagttttttcgtcaaaaataatctgaaaaagaagtaaaagtccgcattatgtggcaggccactgtactaagtacaaagacctttcaaagttgagccaaggtaaaaatgtcaaattccatacaagaataagtccacagaataattaccaacacttctctcaaaatccctaatagttttcttcaaataagagaaaagcaatattcataaaaaactgccagtcagagaaagagcaaatacgattcaaatttatattagcactctaatgtctacaataaaggtataaggggtatttgcaaagctgagattagtcaaggtttaaactgtatcacttgatactaagatatggcatactactttggagaagtctgacctaacagaaaaaaaagtagacatcaaaaaaaagtagacatcaaaaaaatttttcaggcaaggcgcagtggctcacgcctgtaatcccagcactttgggaggccaaggcgggcggatcatgaggtcaggagatcaagaccatcctggctaacaaggtgaaaccccgtctctactaaaaatacaaaaaattagccgggcgtgatggcgggcgcctgtagtcccagctacttgggaggctgaggcaggagaacggcgtgaacccgggaggcagagcttgcagtgaaccgagatcgcgccactgcactccagcctgggccacagagcaagactccgtctcaaaaaaatatatgtatatattttcagggaccaggcatggtggtccatgcctgtaaccccagtacttttggaagccgaggtgggcggatcactcaaggtcaggagttggagaccaacctggccaacatagtgaaaccctgtctccaccaaaaatacaaaaattagctgggcatggtggcatgcacctgtattcacagctacccgggaggctggggtacgagaaccacttgaacccgggaggtagaggttgcagccatccagtcagccgagatcgtgccactgcacttcagcctaagactgcctcaaaaaaaaaaacaaaaaactgtctttttttccgagatgttgtttcattcttgttgcccaggctggagtgcagtggcagggtctcagctcactgcaacctccacctcccaggttcaaatgattctcctgactcagcctcccgagtagctgggattacaggtacatgccaccacgcccagctaatttttgtatttttagtggagacagggtttcctcatgttggtcagggtggtctcgaactcctgacctcaggtgatccatctgccttggcctcccaaagtgctgggattacaggcgtgagccactgcccctggcctttttttttttttttttttttttttcatttttaaagagacaggacactattataacactaaaggtcgatagattttttttttaatgttgaagtttgtgttaagaaaaatttagaaaacacaaaaggaaagcaaagctactttgtaagcttatacaaaagcataatccaaagtagttctcaaaagtatgtgaatatatatcatgttaatgccacttatggaaataattttatattttgtcataaacaggttaagatttttgccatcaatataaaaggtcaggagtaaaatgaagagcggcaagagtgtgccagacttccaggaagaaggctgagggagtaacaactcctaggaagaaactcacttctattcactgccaacatctgagagtttgtagtattccctgcaacactgttagggagttagaacatttatagtgggtgctagtcttagcttcattgtacttatcaggaaaaaaaaaaggcacagaggatagtcaacttacccaagttgagagagctaatagattaaacccgtagagttaccagtagaactggtagattaaaatgccacagaaacccaagccatcaaaatctaacttctgattacagcacacggttacactaaatcttaccttcaattattaccagctgtatgtctagagggtatttttatatcaaccataaaatacagatttgatcatgtcagtcctatgtgaatcaatcgatctttacagtcttcctcaacactctggcacggcaatatagccattcaagtaccctgtgccacgtattttcacactttcacacacatactgctcccttacctaaaacatccttcttcccattctttctagtaagttcttaggcatccatcaaagcccacataaaatatcctcttttacctctgccactattgaaggcacttggtagctgccttcccatacatatgacattattatgactatctctgtaagtttttgtctctgccgaaacctactctaacactttactgtgtgatgcttaaagataaggtgcgatgtgcaactgaagccataaccatgaacgtgaacattttgtgctgtgactttaaatccattagaatgtcttcaacgcaaatgaatttgtacccatgcatgttatatggcatcatgcaatggccctttggaaatagtggtttactaagttatatagatgtaagtgttgaaacttatatatcaaattcattacataacattatgaaaaaaagctattgcgctcacagtggtattacaagtttctcaatctaatttttatttgaaaccctgaattttatcactgacaaaaaatatagtcagttgttttctttggttcatttgagagaattcctgccagtagctagacccaaataaccagtttgtcaatgagtcactcttttttttttttgcattccaatcttgggtttattcaacacaattcttccactctacacaacaaagtacaaacacaatgtcatctaaaatgctacaaaggtataaaactcaaagagaaattttatagtactgactgtacaataagaaaaaaaaagaaaagcaatgtacatgttgccaagataacctgaaagaccaccatgaaggacaggcacaaccatggctgcgggatgaccccacagagctggctctcaactcactcgccaatttcagagtagggtggtggggtggtgtgtgtgcataggtgcacggacagacagaaccatgcacagcaactaccatgggtgagaggatctttgggggtgtgtgacccttgaagtcggaagaggcctcgagaggccgggcctaacagggttggcagctgcactaaaccctggggcagctccctttccaaaaggacactgcccagcgacagcaagggcacggcctggccaccatcccaggtcatcagggaagggaaaagtgtgctcccaggtaggcagggtcaaagcacccccaagagtcttacttgtccctggtggctctgccactgaactgactcttagaaactggaaatgggtgagctttctagccagaaaaccagagggaatcttgacaggcacacagtcaatgagtcactctttctaaaagtggggaaaagttcatctcaaaattcaatcatacaagggcttttttttcccttgagacaaaccacagtacttcagtatgagaaatgctttctatgtatttcctatttcatcacagaatgttaaagagatgaactcaatggtagacatctaatacatgtatactccaacactgacatttttcaggcacagggtcttgctatgtcgtttaggatgaacttgaactcctgggctcgagcaatgctcccacctcaacatcccgagtagccaccatgcctggctccatcacaaacatttttaaatacatttgcatgttactgctgtgaataatgcaatgactgctgctaccctggtggcactatcttgattcctgccaaggtgacaacagtattatccactatttactttgtgccattggtgcaaaaataacattttattatcacaaatagttttgaccttaagggtccctgacccaaggtcaaaactgtttaccccagttattttaggaaaataaataaggcagaaggaaaaaaaaaatcattcctttgttgttcaaagttatttaagaattatgtttacttccatatgcattagacagtatgaaatggaatcattctacactattgttatttgcccacttcataacaaattcaacaaatcaataccaaagtattatagtatatggatagtttatatttacctaatcttccctattgctggatatgttgccaatttttcatttgataaacaatctgtaatacacatatttctgtacctgtccaaaatccctttaataaacagctagaagtgaaattgctaacttaagggtataaatgtgtacttcacatagtacctgacaatgtcacctattaagaaatcttagaatatgctttctaagttaacatttttcaaatgttaacattaaacatttttcaaactgctttctacaaaagttttaccaattaacacatcagtaagggttcttataccctaaccatcattggttattaccattctttaacctttaaaaaaaatctttgctggttaaattggcatttctttagttactattaaatcttgcagacacaagatttaataataactaaagataaaaatgtgttgatcaaaggtatgccttgaaagaccttattcagtctgccataaaaataaattttaaaatatataaagaaattaagtgttctggttagctgatttaaggaggtagtacctaaaaaactaaaaccgttataatactttaaaagtactaaaatagttatatctcaagtaattttttacccctgtttgagataaattattggaggtagttcctcaaatactcacttgctgatcttcacctaagttataaatatcacccatgcattttttttttctttttcattgtctatgttctccaattagcttaaaaaaaaaaaaagataccagaagagtcttgggttatgttacatgaccactattatgttatctttttttaaaaaaaaaaaaaaacatgactaataacacaaatgaaaagttaggcttgtttttcgaaaaagagacagtctcactatgttgcccagcctgaaaaaattaggtgtttttacatgccaaggtatttatagaattaatatttatggagcatctagtatggggcagatactctgccctcgtggaacttaacatgctagtgcaagagacagacaataagcaagaaaacaacaagagtttctaataaagatggcaccaatttaaattgaatgataaatccaaagagtttaaaagaagttataaattacaaataccaagtaacattttataggaaactgagaggtattagaaaagaaagaacatttttggacatctacaatgtagctgccttgtagatacaccagtatgtacgtagcatagtctagtggttgtagtagggtgatttagtttgaattcactttactgcaaatttgtatgatcaaatcacagggaacaacagccctttaaagagacagtactaaaagaggtcaaagaaaagataatctacttgtatttgaagtgataaagtttgctttcttcattacaatgcaaactacacagctgctgacaaataaaatggcttcaagtcatgtctgtggctgatatagcacagactggctcactcacctctattccaaccccttccccatgaaagttcactgcatttcccatactactctttagctcaggctccacatgggacctatcttcttccaagcagctgcaatactttgaaatctcagaggcagaagagataccacatggaggctgtgcttccacgatctccatcaatgagcacagctgtagaggcatctgatggttctgcagcagctgtagctgagatcccagcacctggttcttagcttcacgggggctgagaggcaaagagtagggcatccatttacctggcccagattataccaaagataatgtggtcctagagccactcactgtggcagcagttctcgaattcccagctccctgatggtggcagagacaaaatccactgtgagccacacaactgtcattcctggaagctcagcctgctccctcaacccttccaaggatataatgaccacctctttttactttattaagcctttctgtttgaaccatacataagaaataaactcttaacaggtgtttaaaatcagatgtctaacaaaactgttgatgttgccatggaacacctgaggtcaagtattattttcgttaagtaaaatagttacataagaggtgtatttttttggtgaagaggcacaaaataacagtatagataagactacctgcaaaagtcatggaaattatctctagaaatctacaattatgggcttgtctcaaatccgctttgtttttttttttggagatagagtctcactctgtcactcaggctgcaatgcagtggcgcaatctcggctcactgcaacctccgcctcctgtgttcaagcaattctcctgactcagcctcctgagtagctgggattacaggtgtgtgccaccatgcctccagctaatttttgtatttttagtagagatggggtatacccatgttgtccaggctggtctcgaacccctgacctaagcgatctgcccacctcggcctcccaaagtgctggaattacaggtgtaagccactgtgcccagcccctcaaaccccctttgtaatggactaatgtagtataaacattgtaaacaaatataaattaaaatattcttacttgactgcagcaaatacattatctccatttggaacaattatacaatttttctttgcttcatttataccaacatatacaggaaattcatcaggagaatccctgtgtaagcaaaagacattaaaaatttagctgcccataatttatattatcaggcaagtgggatttcaggtctacagacaacaatttacacctattttttttcctttttggaggcctttttttttttttaatcataccagaatttatcgattacatcaaacaaaaatttctgtaatggaaaaggcaagttgcagtcataaaagatggcattcacattcattttagaaagcaacaacgtagatgtaaaaaattgtttaagtgaaaaatgtaatattgcagtcccattttgcaagctgaaaaattttgtcaacacacataaaatctgcacatttacatactgcatgttaaaaaattccatcactaaagtattataaatattgcaaagttaggcttaaatttatactgttgctggtgtatatgtagtagatatggaatgaatgttttcagtttagtaggtagcatcctcaaacaacggacaacagttgtgaaaattacaaagacatttcaatagctcaaaattatccaaattataggtacatcgtcctattattacacttttttccctttctctgtcacaaataggatgattacattgtagtggtaggaatactgcatggtctacttcaaattattcgatctgctaaccccacactagtcatttttcatcagctcctcagtaaaatatcttttaaaaaggaaagccaggtccctcccaaggatctaggttgatgccttttttataagggcatttttaaaaaaattcaaacaaatttgccagttttaagctccaagtttcttaggaatatctatgataaatcttatataatggaacctaaaactaagattcttaggacctagttgcttttatactcaaatacaaaaaaaaaaaaaaaggaaaaacaagaaaaaggattgtaaaacattagagatgaaaggatcctattcacgtatataaccaaaccttttattttaaaattgaggaaacaaataccgagaggttaaattactcagccaaggacctagtaagttaggaccttggctacagtataattcaattcctagccacatgtgcattctgctgtactacaacacttcttcctgggcacgttccttctattaccttacatttaatcttcactttaaaggatagcatttctactggtacaagcggacaagtattttcctcctggagtttctctatttctaagtattctgcatgcattcatttaattctcataatattcctatcaggtatgtacagttatccctattgttacaagacaggaaaccgagtcacagaaagtcacagtcagtaatgatacagggtcacacagataataaacaagaggaccagtgtgactccagagaccactcttaactaccagttgccactctggcacacggcttattaagcacagctgctctaaattatctttcttgggccaaaagagctcttctgaacccaaaagggaaaaaaagtttacaaggaaaggaaaaacaagtgagattaaacctaaagagtttacccatcctagggaaggttaaaacggtaacagcaagaacaacagatggctcatatatccaccaacaggggaaaatatgcctttcaccttgggtgaggctagtgaataactatttatcctcattagcaggacagcagctgtattttagaggcgaagaaaagatcctttacctgaaataccccatgtggtactgagttttattatctccaataataatggtctggaactcaggaggatcatagtaaaacctccagtgaaggttaaaattcaggcctgttgattttttcttcgttttatgttttccagcaaggatatcataaggaccaactaattgaagtccaaggcttgcagaaagtgaatctataaagaaaataaatttagacaatactttctggagacaggtaggaaataatgcttttatttagtaaactatttctaagcaattgtctttaaaaagtttctaaactaaaaaaatcttgagttatgtgtgaagatgtcagttataaacattcaatggaaaagaagtcagagtaacaggaaaagtggtatttacatttaggatttcctcttaaatttaccactgaattagcctaacatttcagacattcctgttgtttcttattttggccaaagcaagactggtttgtattcctataggcccattaccacactgcagttagcctcaaatacttgtagtacacacaggttaagggagagaaagatagcaaaaatgtgtggattaagagtagtaaaaaacaggccaggtgtggtcgctcacacctgtaatcccagcactttggcaggctgaggcgggctgatcacctgaggtcaggaggagacaagcctggccaacatggcaaaaccccgtctctactaaaaatacaaaaattagccgggtgtggtggctcacgcctgtaatcccagctattggagaggctgaggaacaagaatcacttgaaccctggaggtggaggttgcagtgaaacgagattgcgccattgcactccagcctgggtgacagggtgaggctctgtctcaaaaaaaaaaaaaaaaaaaaggtaaaaaacatttctatcccctttcctctacctcagctaatcacaccagattcccctgactctttgacaatctatttggccaaccctaaccctggatgactccatcttccttctctattcacggatcacagacagggagtgttcataaaccacaaagacatgaagtctgtgcaagtgtacaatgcataacttcaaatgggtccttacttctaagatggagggaagcaccccagacaggacccagttttataaggagggaaggatgaagaaaacaaaaaaattcctggaagaggtaataacatgaatagaagcatggagataacttgacaggaaaaatagttcagcttaactgaagcttaggagagcatacactaatttttaaagcatgaagaaaactaaaaccatccatctcattagccgaagataacagttaatagtctattatacagtaacaaatttccatactctccacccccatgaacagatacaaacatgtaacaaactgagaagggttgttttgtattgtaatctgcttttgtcctccatcctgtcccatttaaatgttctgaatatttttccatgctattcaatgttatttgacatgattttttaatagggcataatactgcattataaagaggtaaccatctattctcttactgagggaaatttactatttcttttttctgttctaaaatgtttcagtgaacatctttgctaataaatgtttgtatacaggcatgacttttttttttttttttttttgagatggagtctcgctctgtcacccagactggagtgcagtggtgtgatcttggctcactgcaacctccgcctcctgggttcaagcaattctctgcctcagcctcccaagtagctgagattacaggcacccgccaccacgcccagctaaaggcatgactatttttaaagaaacagctacacagttctgttctgatctactggcaaaattcagaatatgtatcaatacacatttccatcaatagtgtatgacagtgcctactagttaaaaaatttaaatagtatagtgcaaagtaatgaacacagcccattaacagtttctttatcctttcagagacaaaataagcacacagaaaagtatacagggatatgtgtgtactctctctcccccatgctatttttaaaaaaatactaatggtagcatactctatacactcttctttttcacttaacatatttcaggcatgatagtttattatttcctaaaaatctgcttcattcttttaaaacaatgaagatctactgaatagatgtggtattggtaggcatttaagccatttcccattttttctttaagtaaatatcctcaaacataattcttagtttatgtaatccataagacaagttcttggaagcagaactgttataactcctgcaacacatgaaagagcttgctttccttcacattcccccagaatgtgatgaaattacctttgccaataaactaggtgacagtggcattactatagcattaatctatatttctttctatattttctcttactagaagaaacatcttggaaaatatttgttttctatgaacagtttatatccttggttaggtttttttttttttttttttttctgagacagggtcttgctctgtcacccaggctggagtgcactggcacaatctcgactcactgcagcctctgcttcccaggttcaagcaatgatcgtgcctcagcttcccgagtagctgggactacaggtgtgcaccaccatgcccagctaaattttgtatttttagtagagacagggtttcactgtgttgcccagacgggtctcgaattcctgacctcaagtgatctgcctgcctcagcctcccaaagtgctgggattacaggcataagccaccatgcctggccaattattctatgttttagagacggggtcttgctctgtcactgaggctggagtgatcagagctcactgcaacctcaaaccactgagctcaaggagggatcctcccatctcagtctcctaagtagctaggactataggcacatgcaaccacgtctagttttttgtttttgtttttaatttttttgtggaggtctcactatgttgaccaggttggtctcaaactcctggcctcaggcaatcctcctgcctcagctgggattacagagtgtgagccaccacacccagctggtttcctattacattactctttccattaatacaagaatgattctggagcaactcaccagatggcttttcaggatcaagttcttcacagaacttccagaagtgatagaaatcttcaggtaaagaaagcttataatgattttctacttcttttcgaaggtcactggagacatcagcttcacagaatttacttttcttcacatcagttgttttttcacactgaaaattggcacacaaactttagttctccaaatttcagtaactctccttgcataacagtatctatcactcttgttcacccaactctatgaaatacatgtgttttccttaaaactctctaaatggtctttgagtaaaatctgggaattcatttgggcacaggaaaaaagagtagtttatatggtggttaagaggaatccacacagcaagtctttaaatatatttttgtaagataatggaaaccacaaaaaacaaaaaggtaaaaaaaagaaataataaagagcaggaagagaggaataaagaaagggcagattttgccctcttttggttaaaggtgtgagtcttttaaacagattcattgatcaaatgagaaacaaatagaagtaactggatataagcaattcatcagttaaaaagctgtttctttagcaacttctagagttgtgtctgagctattcactacaatcattacccagccttaaaaacagatacctcccttttgattttccagataaagagggaaggttagtgacaatgttaaacatctatagttcctaataaagttagcagaatagcactaaactctgggccaaaaatccaattatttcagaaaaggccttttaatgccaggatgaagttataatactcatctctaggaccaccacaatacaggttcattatataagtatactaggttttataatgcctactagatatttgataaatttctgtaaagacaatatgcttaattggaagttacgtatgtttagttttctaagcagcaatctgtttttctatgaacctagattctttctttttggattaagttctttcctttttattcttcctacctagagcagtggttctcaaccggtggtgattttgccccccaggggacatttggagacctatttagttgtcaccaattggaagaaacggtgctagtggggcagaggccaggtatgctcaacatcctataatgcccaggataggcatcctcaacaaagactactggccccaaatgtcaacagtgctcaagttgagaaattctgagctagatgtttctcatatttatatatttttttattttattattattatactttaagttttagggtacatgtgcacaatgtgcaggtttgttacatatgtatacatgtgccatgttggtgtactgcacccattaactcgtcattattaggtatatctcctaatgctatccctccccccgccccctcatatttatattcttctattttctcagtagtctgaagtttattaacgttaggtatcattcaacgtctacaaaatgtaatcagatgatacaagaatggtcatggtggcattaattccaagagcaaaaacagaacaaatgaaatacctattgttaggagaacagttgtaaggttttcaaacaatagactattacacttaatattacagttgacccttgagcaacaagggtttgaattttgtggacccacttatacatgaattttttttccaaccaaatgcaaataaaaaaatacagtattcttgggatgtgaaatccacttatagagagggccaacttttcgtatactcgggttccacaggaccaactttggaacttgggtatgctcagatttggggatatatggaaatttgttactgtatactagactattaactgtgttatctttggctaatgagatggtttgttttcttgttgctttaaaaattagtgtatgctctcctaaggtcctggaaccaatctccgtcatttaccgaatggttactctatggctacacaatatggaccaacctatattcaatatttttaatgaggaaaaaagctcttgattatatgcagcatgatagcctttttatgaagttcaaaaactaagaataaatattgtttaggtatacactcatgggagataagcctatttttaaaaggcaagggaaaacaaaattcaggatagctacactgaaaataattgacaggaagaaggctgaacggataggagaggaacacgtgtagatgtagagctattgtctgtttcagctttgggattgggcaatgggttcactggtgtttgttacattacttaacataaataaggtcaaagacgatcatgaatatggtaacagtttattatgccaaggattataatgtgtctgatttataaaaaaaattacgttcaacaaaaagcctgttgaacaatgaatccaaaagtgagtatcaataatagcaaatagtaatagtaaagataatataatagtaaaaacaagtagttaagtgatacttactgagaacttattttgtgctgtttcactgttctaagcaccttctgtggattaactcatttagtcctcaactgtctcatgcactagataccattaacctcatcgtacagctgaggaaactgaggttaacctccctacgtccctaactaggaagtggaagagaagggatttaaactcaggtttaaatctgggtccacagcagatcctcaaccacttcactatgctgcttctccaacatcaaatatagaacagtaggaacatatgaagtcctgagctatcctatcttctgttttcataactgtctttgttcagacgttcaaagactggctccaacttaagatgttagaaaaggcttaatctgccttgctgaaaggcagttttgcataatagttaggttgcctgggttgactcctgactctactgatttccaaccttaggcaagttacttaacctctctgtgctttgttttctcatctgcaaaaagggcatacagtgcctatatcggggttgttacaaggaatgttattatatgtaaaaatacacagaacggtcctagcacataatatacaaatgctggccattacggttatagtctctacagactcatcttcatttctgttattgtatttctagttaagcacatcactccaccaaagcagttcttcactgcaccttcaaaaagagaattttttcagctgtgcctttactcacacactagttcagcatctccatagccctaacaactaggatttagaacagctgtccccttcagaggctacacttcttctttaccctggtcttcctagaatgcatgacccaatatgaaggatgcctataccgatggccctttaacagttagttaagccctctaagaatgtctcaccctgtccgatttatgacactaccagagtaacttttctaaaactttagttatcacaatggcacttctttcctgattccccttattgctactgtagtggttacagaacttccgaaatcgtagtaaagtatgagaatgcacacactctctcctcctcccctctcagtagtgcttttatgatcaggtccctcttattttcccatttccctggctccagccaagccgaacgctccgctacgcccaaacatctcctacagttttatgtctcagaatcttacttctctgccttcaaaaccaattttcaaagagttgtcttaaaagtcttctttaacaccccctgggacttgttaaatcctccttcagtgtttccatagcactttctacacaccagcgttataatcccaaacaaaaaagtcacagtagaatgcatatttgcttgtgcccctcctccccaggccgagggctcaacaagcagcaggagcaagcaggttgacccccaaatccgcagcgccccacagaatgtcaggtatgtaatcggttcccaatcaatctggctgggcgaatgaaccattggttggcttaatccgtttccccaggaaatgctccaagaggagctgggcagaagatgcagaggagctactttcctggtccaaccccctgcagagcgcgaaacagcggccctgggcaggatccccgcagcaaaccgcagcccctggacacacagcaagcttaatagtcactggatgaatgaaaagcgctgcctcctggtgccctggctgtcacccaaagcgccccgcgtagcccgcacagcctttccggcagtacctgcggcccctctccgccgggcctgcgcttcccgccaccgccgaccattctgcagctgcagcgccagcagaattccccgatccgcggccgcttccgagcgccgccaaccgcttccgggttcaaaagcctccaagccgaatttcagcgccgcccgggctcgccaatttaggggaaaggctccgcccattccccgccccctgagacctggcaccggacgcgttgaggccccgcccactcccgtgctgggcgcgtgcaaggagcgtcttctgtcagcgtagtctgcatctaggctttctggagcatcttccagggtcgctccagagaccccccagactactgaatctgaatccttagagtggtccaaccttcctcttcaggtgtctactagaggcaaggttggatgtatgcggctgttctcaatacagccccttccttgttttttcttcatttatatttacttaaaatattaatccttttctccttctcctccatccctctccctaccctactgtacggttattggcttacactaattcattcccgattgtctccaagaaggaaataaatgtctgtcggtctctgtctctgtaccgtcgtcttcttggtacaatttggactgtttttcctctacaccgctgatatgcaaagtgtagtccctgaaccagcggcctcagcatcctgagggaatttgttaaaacgccaaatctcaggccttacccagacttactgaatcaatatctgcatcgcaacaagatcccctggtaattcctatgcacataaaatttggaaggcacaactctcaactgatgtccttggacctccttcacatccatcctgggaaggtcttattcctcattcctgagatgagttctctatttcctcaatctgggtgttcctttttcttgattatataccctcatgttgtggaacatatccgccaatagttccttgagagaggttgctgccaggtcttttttcccacagagtgtgcatgtctggaaatgtttttattctggctgagcacagttctaggttgaaaataactttcactcggaatattggagggcttgctccgcaatattttagcttccagaattgttaagaaactatgtcgttatatttccttctccttcacaggtcactaaatttcttgatatgtaacctgctttcctttctgttttgttttgtctcaagaagctttaggatcttttctctgtttccagtgttttttgttttgttttgttttgttttgttttttttgagacggagtctcgctctgttgcccaggctggagtgcagtggtgccacctcagctcactgcaagctccacctcccgggttcacaccgttctcctacctcagcctccggagtagctgggactacaggcgcccgccaccacgcccagctaattttttttttttttgtatttttagtagagacggggtttcaccgtgttagccaggatggtctcgatctcctgacctcgtgatccgccctcctcggcctcccaaagtgctgggatgacgggtgtgagccaccgcgtccggcctattcccagtgttctaaaacactattgagtgtcttggttatgggtcttttctcattcctatcgaccagtttttcaatcctgaaacacatgttcttcagttatgggaattcttctggtattatttatttgatcatttcttcccccccaccccccatcgtatctcttcttttttgaaatttgttatttagatcgtggaccttcttggctgatgttttttcttacctgtctgtcctattttctatgtcttcatatttttattctactttctctgtgactttctcaacttaattggacaattacttaatttctttattatacttaataaagattaattacttaatttctgtattatacctttatttctcagtgctctttttattctctgttcttttatagcattacattatttttcatgaatatagctccttttatctctgaagatgtcaattatagcgtttttaaaaatgctttctacgtaactctgcattgactttgattcttttgagtcttttttggttgtttgtttgtttacatttggttcctgttgtttctgctagaggcattcttcatcttgtgtggtgatccttgctgtcaatttatatgtaaaaatgaggctctaaaaaggtgctttggggacataggcaaggcttgtttactgctggacaaggtgtaagatgatggggaaagaaccagctgtttattttcttctagagagtaatcttctaattactcactttgagaatatacagacttcttggagcccaatgcaggaaggaggctgggagtcttaataatttcattatatgcactgtattagtcggggttctccagagaaacagaacaaataggtatctatttatctatatctatacctacatctgtatctagctatctattagctcacgtgattataggggttgagaagctgcataatctgctgtctgcaagctgaagatccagaaagcccatattgtagtttgaagccctgataactggggagccaatggtgtagattccagttcgagtttgaagtcttgcaaaccaggatcaccaagggcaggaaaagatcaaagattcagttcaagaatctagcagagagagagtgaatcctcccttcctctacctttttgttttattcagacccgaatggataagatgatgcccacccacattggtgaggataatctcttttacttagtgcccccgcagacactcagtaataccgattaaccaggtatctgggcatcctgtggtccagtcaagttgacacataaaattaactctccaccgcgtgtggcggctcatgcctgtttcccagcactttgggaggccagggagggtggatcacttgaggtcaggagttcgagaccagcctggccaatgtggtgaaacctcatctctactaaaaatacaaaaattagccagtcatggtggcacgtgcctgtagtctcagctacttgggaggctgagatacaagaatcacttgaacccgggaggcagaggttgtagtgagctgagatcacgccactgcactccagcctgggcgacagagtgagactccgtctcaaacaaaaataagataagatataattatgcataccttcacttaacaccactgtttcataatagcatttttaccttcagctgtgtctggtgtccctgaatccatattctggttccatatctcccaaaagaaacaatcttcaggttgggaatggaggttagagaatgtttccctgactttgccaggggaggaaatctaggagtcttaactgcttctgggacttttaatggtctcttttcagctcaacccactgaagaggtatggtacttccaattcctgagccattgtgaggttctgcagtgtcagtgagcttgcttccaggcatcatctctgaaaacacttgggttttctctgggaagtccatatgttcaccagtatattagctccctaaagctgccataacaattaccaaaaactgggtggcttaaaactatggaaatttattccctcacagttacggaggctagaaataaaaaatcaaggtgtcaggaggttggttccttctggggactgagggacaatctgtgccatgcctttgccttagcttctggtgactgctggcagtccttggtgttccttggcttgcagatgaatcactccaatatctgcctctgtcattacgtgttctccctgtgcatctgcctgtgtctaactttctttttgtaaggacagcagtccgttagattacggcccaccctaatccagtatcactttatctttttttttttttttttttgagatggagtttcactctgttgcccaggctggagtacagtggtgccatcttggctcactgcaacctctacctcccaggttcaagcaattctccggcttcagcctcctgagtagctgggactacaggcacgcaccaccaggcccagctagtttttgtatttttagtagagacagggtttcaccatgttggtcaggctggtcttgagctcctgacctcaaacgatccacctgcctcagcctcccggagtgctgggattacaggcgtgagcaccacacctggctgtcactttatcttattttgatcacatccacgcagaccctatttccaaatatggttacagtcaatgtatcctttggggggatgcagttcaaccacatcaactgatttctaaagttttgtggcatttttcagttgtctcttctccagttttctttgtttttatgagtatatggtccatctgtccccctttttaaccttctttatctttgttttagtgaggcttcttaaggagtggaggaaagtggatgttttcaaggtatgttaagtatgttaactggaggatttattgttgctatttttcagttgaataacatcaggttggcagttgtaacctgtaaaactgcacttattatatgcaatttcaagttcagaactaaaactttgctctgaataataatttgtaaccatcttttatagaatgaaatttctattttaattcaaacatttgacatttaatatattttatcctgttcatatgtttactccacagtgattttgaaggaatgggtagagttgaccaaatttggtatacttcttcaggttatcagtgtctgtcattttgaaacaaagttattattaataaatgttttatatctagtacttactatgcaatactattcttttctaatatttatttttaattgacagataattgtgtatatttatagaatacaatgtgatgttttgatatatatatacacacagtggaatgattatgtcaagctaatttacatattcattacatcaaatacctattgttttttggagtgagaacatttcaaatctactcttctaacaatgttgtcatatgtaatacattattattaactatgttcactatgtggtgcaatagatctcaaaaacttattccttctgtctaactaaaactttgtaccctttgacagtatctctgcagttcccatttccaacccccagcctctggtaaccagcattctactctctacttctgtaagttcaacttttttagattccacatataagtgagattatgcaatatttgtctttctgtgactggcttatttcacttagcataatgtcctctagtttcacctacattgtcaaaaatgacagaatttcgtttgttaaggctgaatagtattccattgtatatgtaccacattatccattcatctgttgatggacacttatgttggctattgtgaataatgctgcaatcaatatggatgcctagacatctctttaacatgttgattgcaattcctttgtgtatatactcaggagtgcaattgctggatcatatagtagttctagttttagttttttgaggaacctccacactgtcataatggctgtgttaattaccactcccaccaacagtgtacaagagtttcctttttcttacattctcaccaacccatgttatctttgataatgtctattgctattgtaacaggtgtcaggtactatctcattgtggttttaatttgtatttctctgataactagcaatgttgagcatttttgaataaaccacaataatactaagtgctttgctgagactaactgatataagccacataccagtcatgtgaggtaattcctatttgtactcccattttacagataaggcagctaacattcaaagaggttaagtgaattttccaaagtcacacagcaagctctggaggtgggattcaaacctgaatagtctatcctttcagagtactttcaacgctatgcaatactgtctgtctagcaatcagccagattgaataaagtctgtagttcacagagccacttgcatttttaatcctagtttaattaacttaggaaatttgtatctaaaggatgcatctttaaaaaaaaagagagagagacaggatctcactgtattgcccaggttggcctcaaactcctgggctcgaagccatcctcccatctcagcctcccaaagtgctgagattacaggcatgagccaccacgtcctgccaggatacataggttttactgtatcctctgaacctccctttaatcaagagagtggacaaaactgtgggtccctcattttcaaaacggccagtaaaagaggaaataaggaaatgcaatgtttaactattctgctgccctctttaagttgattgaggacctctttgtcactacttcaggaagataacttaccttctcttattcactagggctaactggagcttttctcatgtatttatggttgctgggaaattttcaaataaaattcactgggagtggtttgaaattgcagaatttttagcctctcaatgttttgttttcctctagtgagtttgacataaataatatcctcttttgagatttgtatctttgaaagactttttttttaagtttctcagtgaaacaaagaaaaagttagaaggtggctgggtgcagtggttcacgcctgtagtcccaacactttgggaggccgaggcaagtggattgcctgagcttaggagttcgagactagctttggcaacacggcaacaccctgtctctactaaaagcacagaaattctctgggcatggtagcacatgactttggtcccagatactcaggaggcctaggtgggaggatcgcttgagcccaggaggcaaaggttgcagtgaaccaagattgcgccactgcactccagcctgggtgacagagtgagaccctgtctcgaaagaaagacagaaaaaactagaaggatatcagttttattagaaaaaataatttaaaaattgccagtttccctagaattaagccataatatgtccatagctttgtatcagattgctgactttgcctggggagaaagttatatttgtttgtattgttttttccttttttgtcaaatctggggtgacacaatggtcatcaatatacttttagatctatgtcttcattggggatgatgctagtgagcttacgtggaaaaattatctgtatgaaagcagaattgattggtcattgccagcacctttgattttcccttaataattataatatgataacttaaaatatgtgtttttatagaaatctgtgtcaaacaagatatatagaatgtgattctgtagaatactaataagtgagaattcagatgtgggctaccagaactatagagtgacaagtaaaatcagtgaaatgtaaggatggcacggttcgaggttctcaaaccaaataaaatgctaaaaaagaaaaggatcctaatcacaatacagatttagagaacacacaacaatagtagctatgaaatgtatatttttcaggtctaaaagttactggatttgctatgtaggtggtagtccttggtgaaacatggattaataaaagacagaaaatggaagcaagagttcctatgtattctttaagagcgtctgattctagcattcatctaaatttaagctctagatcaaagagaatatttttagactgggtgtggtggctcatgcctgtaatctcaacactttggtaggccaaggtgggcggatcacctgaggtcaggaattcaagaccagtctggccaacatggtgaaaccccatctctaaaaaatacaacaattagccgggctcggcttatgcctataatcctagtacctgggtggctgaggcaggagaatcacttgaacctgagaagcagaggctgcagtgagccgagatcccaccactgcactccagcctgggcaacagagcaagactctgtctcaaaaaaaaaaaaaaaaagagaatatttttacaagttttttctttttttttcaatctttgtgcactttgaaggccatagatgtcatagctagcttcttaagcatttctttctgcctttgttatgagagctgctgaaaattaaagacaagacaagatgccacttaggatcccaggacttgagagtgtagccagacattcagcattaacgtgtattcagggcagaataaccacatagagcagcacatgtgtaaggaattacaggcttatccaattgaatttctaaggttctaaatgatggaagtcattcactctggcagtcaggattgagctgagtcctgtgactcacgctgttggccaaccctggaggataaatcagctttgagaaggcccagagcccccatagccttatgattctgattcccaaataggctgtaaaataggacttcttttaggggctattcatagcagggggacctaatttgggagatatgggtgattgtattgcagaagaaacagatttgggaaggataaactttttttctaatttgctgtataaaagttagcagaagcttcaggcagagctgatcctagacaattgttattgatgggctgcaaatgagctgtagcattaatctttgacactgcactcttggccttacctttggccactttgactctggcaaattatacagctaaatggtggtgaaactggtctgcccaattatgcttaatccagatcagttactctgggaccatgtaacccttaattagcactagttggatgatccaaacacatctttgaaaggccccagaggttctccagtcttcatatttacagtggatgaaaattccagctgattcgccaattcttttcctaccacaatttcttagaatctagctctgagcacaaactggcacataatgggtgctcagtaaatattaattggcttatcgacctctttaatgaatagcagtcaccatcattaaatagttacttgcccatcctttcatccattcagttatttgttcattcagaacatttattaagtcccaattatgtgtcagaactatgttaggcactgaaaagaccaagatgacacagttgctatgttccaggagcttatagtgtactgaggagtcctataaatgtacagtcagtattcctgctagtcacatagaagcagtgtaagaattatgtaagtctttatcacactccaaccttccagacacattgctccagagtagtctctttaaaagaattgatctaatcattttactctgtgactatcacagagttgatcagagcaaaaattctgaacgactagtgttaccaccaggaaataagaagtgacacaacaaagggcgatatggtagagagcaagctcaggtaatatgaggagtttgcgaggtgatgttacaagggaacatcaaaagcagcaactgagatcaagattgtggaaaatagccaaggaaacaggagctgggaatgtagggagcagttactagaaggatccaacaggatattactattgagtaattgccttgtataaggtcattctcctcaccttccaagttatgtgtttaatttctgaatataaagttatacttaattttagggctgggtgcagtgggttattcctgtaatcccagcactttgggaggctgaggtgggaggatcacttaaatccaggagtttgagaccagtctgggcaacatagcaagaccctgtctctataaaaagtagtaataattttagaaaatttgaatactatctaaaaataaaaagaaaattaattatattatgccacctagatgtagcctcagacaatatttggtatattcagtatttttctacatgtatcttattatagtttgttaaatgaaataatgctgcacataaaatttggtaataggccttaaaaagtaagcttaataacaaataaacattgtaaaaatgcttcatcaatattttaatggctacataaatatgccattggacaaatgtttgataaagtaactgttctcgtagttataagtttttactgtgtgtcataactttttattgctatgtataaccctgtggtcaacatttttgtacataaggttttaaaaaatattttggaatattaccttagtttaaattcttagaggaactgctggcttcacagacaggaataaacttagtgtcataatccatattcccaaattgctttgtaaacaaggcagtctgaaattgaacaaaacaatgtaccacattgtgactacagttaagaatattgtattgcatatttaaaatttgctaggagggcagatcttacatgttctaaccacatacacacacaaaggtactgtgtgaggtgatgctatgttaattagcttgattatggtgataatttcacaaaaatatatgtatattaaaacatcaagttgtacaccttaactatatagaatttttatttgtcaattatatctcaataaggtgggggtggggaaggagagtaaaataaaaacgttttaaaataaataaataaacagagacaaaataaaaagagcatatgttattttcccattggcatgagttaagggcactgctgcttgggaataacctacacatggtaggataaaaaagtcagggcttatctgatttatctccattctacttgtcttcagccccttcagagttataacctgaaggtcaggttttacaaaatgcattggacgaaagattggcaaacccaggttctagtcccatccttgcatttgtctgctcagaaatcttgagcaatcactcaattgttctgaaacagtttctcaaactgtaaaataaagatgttggaaaagaagaaaagaaaatggaatgaaaatgtgtttttatcagttagaagcagtattggagagtgctcttttcaaaatagcattgtcatgaaacgcaatctttgctaattgttttgtttagtatttcttttgaggttaaacagtgagatggctattttgtgctcagctttccttagcatgaatttgtggtaggtaggaggcgattgtctagccagggactttatttcccagcctaccttgcatcctgatgcggccacatgatgaactgttgctgatggcaagtaagtaggagagatgcgtgtcacctccaggccaggttttctcaagaagcaagggtgacttcactttctctccctcctctgccagctagataaagagggctttgaggctcttgggataacagagccaaagttagaaggaacctgagcctctaccaccacacacaggcaggccacctgacaattcacaacagctgaatttgattggacttctttatgagcaagaaataaacttttattatattaacccactataaattaatgttggtattcatttattatattaataatagctagcgttgtccttttcaatataagaatccacataagattatcaggtaaggaaggcagcaagctgtcctcttttaaatttaactgtagaagccatatatatgttgcaatgaacattaatgatttaatatattaattaaaaattaagaataaaatacttgcataacaccaatcagcacatttttatccatccatctacccgcccggccatcatttagcaaatattcattgggggtcacttatgtgggaggcattgtgttggtctctataaattccaaaatcatttagccactgtataccaccctacctagaatcaatggtagtctgctccaaacagatttatcaggagcttttttttctgggaaggaggtaagatttcaaaattattcatgcacttttctacctgctacatgacggtgagagagagggtagtaattgtacataaagacagtgtatgggaaggggattccacgggcagcaatgaaccaggacattatcagggtggtccatggaatctttgagccaagagagataagaaaatgtcattagaaagtgagtcaagattgagagatgtgtggaaaattaggtgagaagtgagtctttgcagttctgctgtaaatgtatgagcaggtccttgaatgcttctgctatggtttgaatttgtctccacaaaaactcatgttgaaatttgaaccccagtgtgatggcgttgggaggtgcagccttggagtgatttgggttatggaggcggatccctcatgaatggcttggtgttgttcttgcagtagtgagtgagttctcactctctaaaggctggatcagttcccacgggaattttcccaccaaagtgggttattataaagttaagaggcagcctttgagtttggcctcttcacacattttgttcttcctttgaccttcttcaccatgttatgatgcagcaccagatgccagggctctgcgcttgaacttcccagcctgcagaaccatgaactaaattaacctcttttctttataaattacctggtctcaggtattctgttatacaaacgcaaacagaccaaaatagctccttgtcagacaagatagaatttgatgattgcccctggtttttaacaaggagcaatcatcaaataaggcaaaattagaacagtattttttttctgttcttactttctgcttttgagctgtgtcttagataaatagaggcctgccagataaattatttctggataaatgagagactgttttcttattttacatttgggaaattagagtcatggaaataggtggttttgctttttttaggtacatctgttttcccactgctgacataacttctaaatttcagatctttttctttggtaaactacaccatgaaattgatgaaaatggctttatcaatagtttcagatgctgtctgcaaaataaagaggtaaactctgctcctttgctctttaggcattattttcttttggaggaaatacatgtttgtcatagggctgcttattcccaggactcttagaaggaaagcacattgtcatggctacagctgcagaacagctgcttcttttttatttgtttttagaggaggacaacacatttagttttatttttatcaaatcacaacactttcttttccaactgctacaaagtgcatctacaatattctattacagatccactttaaaaaggtttcctgtgacattacagcaagcctcttttttcaaacaggaataatcccaaattcttcctcaaataaaactaaaaactccattccagtaaatggtaaatacataaaaattacagtaagccagacacttaaaaggacagccaagaagtcttccaacagtttattagaaagaatgtagacatttaaacaaatccccactgtcatgaacataaattgaggttacacacatgtatgtttgaggttgcagtgagccgagattgcaccactgcactccagcctgggtgacagagtgagactctgccttaaacaaaacaaaacaaaacacccacaaaaagccaaaaaggaaacaaaaacgcaccccaaagtgatgttggtattacacagatctcaaaacccagagaagtttgatagctcttcaatccctagtacatcactgatgactcattgtcattagtttgcaactgatctgaaatgctcccaggagtaaatagtttgaggtttcagtagaactagaaataacttttattttcttcttcttcttcttttttttttttttgagacagagtctcactctgtcacccaggctggagtacagtggcatgatcttggctcactgcaacctctgcttcctgggttcaagaaattctcctgcattagcctcccaagtggcggggattacaggcacctgccaccactcctggctaatttttgtatttttagtagagacagggtttcactatgttggccaggctggtctcgaactcctcacctcaggtgatcagcctgccttggcctctcaaagtgctggcattacaggcgtgagccaccgtgcccggccatattttttaaataagtaaaacacactttaaagaatgcgaaatcaaaatagtccttcagggcaaaactttaagcagatatttaattggcctgatatttgagtttgtgttctgagtcattttggccttgaagggggagagaagagaaatgtaatagtagagggcgcctttatcttctgtctttccacctaccctacacacatacatgtatgtttgtacatatctaaacgttagtctcacaattctgcaaagcagctagctccattttacagaggaatattttaagaaacatgccccaggccaggtgcagtggctcacgcctgtaatcccaacactttgggaggctgaggcgggtaggtcgcttgaggctaggagtttgagaccagcctggccaacatggtgaaactctgtctctcctaaaaatacaaaaattagctgggcgtggtggtgcgtgcctgtaattccagctacctgggaggctgaggcacaagaattgcttgagcccgggaggcagaggttgcagtgagccgagactgcaccactgcactccagcctgggtgacagagtgagactctgtctcaaaaaacacacacacacaaaaagaaaacaaaaacaaaaacataccccaaagtgatgttggtattacacagatctgaaaacccagagaagtttgatagttctttattccctggtacatcactaatgactcatggtcatgagtttgaaactgatctcaaaggctcccagagctctctgggatactaggagagaatgtcctgagatttttttttagggagctagtcaaacccctgctcggaaacagggttggacagttttgataatggcagatcacaggtcaaagctcccaaatttatatctcctgtcaagatactcttgctgccatcgctagatttgcatttctgttacacggtgaccaaatgtactcttaatttttttctggtaaccagaacttgctggtgggcatgtatccttggtacgagtcactatcacctctggttatagcagtggagcaaagtggtaacgggaaaattcctaggtttttggcctgagcaaaagagtggatagaggtaaatgacaggtggggaatgtggggagagaagcagggagagttcaggcaaaagagctaccatgtcaaggcctacatgtaggagtatggcactttcaaggtaataagtgagctctggagaaatgcctcactctaggacgtagtatgtgggcaactgaggaggttcaagaacaaagttcaaaagaggccgccagagattcatctagagaaccaagcactatgggattcccacatctaaaaatgttgccttcatccatccattcattcagtaaacatttagcagtgtaggactagcatggtttgaggagggatgccctggatttggagaccttaacatgtaactagagaaaacattggcatcctgggctgtggtgggaactacctcccgacaggtaactcactgccagagtcagcaaactaacatctgtcttttttctaacatttgtatcatatggaatcacaactttttttttttttttttttttggagacagagtcttgctctgtcactcagggtggagtgcagtgatgcgatcttagctcagtgcaacctctgcctcccaggttcaagtgattctcctgcctcagcctcctgagtagctgggactacaggcgcccaccatcatacccggctaatttttgtattttttgcagagatggagtttcaccatgttggccaggctggtctcaaactcctgatttaaggtgatccatccgcctcgacctcccaaagtgctgggatcacaggtgtgagggaatcacattttatactcccttcaaaatacaagtgtgtgaaggaaccagtgttttaatccaagcgtgtaagaatgatttcaaacaaatggcgccctttacaaatcaacaaggaactacataaatttaaaactttattttgtggacaattcccatttactctctttgtttttagaaaatggttagccatggctgggcgtggtggctcacgcctgtaatcccagcactttgggaggccgagatggatggatcacctgaggtcaggagttgaagaccaccctggccaaggtggtgaaactccatctctactaaaaatacaaaattagccgggcgaggtggtgcatgcctgtaattacagctactccgaggccaaggcaggagaatcgcctagaacctgggaaggcggaggttgcagtgagttgagattgtgccactgcactccagcctgggtgacagagaaagactctgtctcaaaacaaaaaacaaaaaaacaaaaaaacaaaaacaaaaaacggttagcctcttttatgtttatttcattcatgtttataaatttacaacttgggcataatacaggcatttgttttgtcttttccccacttgctcatattacaaatgacacagtattcctccattgtcctttgtggcgggtgcagttagatgtccccgcgctggcatgagcaggccagggttcaaatgctgcctttgttgcataccaactgcagctctggcatgtaagatggtaaaaaacaaacaaacaaaaccgccacctgcagaggaccgttgtgaggattaatgaggtagtgtcagtttaagtgccccataactggtagttgctgtttctgagtttatcacgaaaccccttatcacgaaaaatttgtctccttaatcttttttcttcctttcctgcttcaatatatcatatgcctctggcaaacccatactcctggcgggctaggcggttggatcttggccccttctctaaggcttttcttgcaggttccccctgcctatttatgggcggtataaaagttattgcggtttttgccattaaaaaaaaatcgcaaaaccgcaattccttttgcaccaacctaatagatgctccaggccgagctgggaggtgttggggtgcacacaaggagagaggacaggctggcctgaaggtccagagcgccggcccggcagggtcaacccagccagcggtcacgaagggaggtggagttgggggaggcgacacagggcaggaagtggggaggacaaacggggtgcacatggggactgtggcgatgacacagaagggacagccggttagaatctaggcccacttaggcgatgaagggcaggtgaagaaatcccgttccatcttcctgtagttcctcccttggggagcccccatcctatcctgctgtggaccggggcgtctcctggaaggcccgcgatcgagatgaggcttccgagccgcccagaagggacttcgaagtgtgcgcagcggactccgcggttcccacgcgccccctagggtgggtggacgagctgggcgcccccgtgcggagaacggaggaggggtccgccatgtagctgttggaaatgcgggtggccgtggggcccagcttgccgggctcctggatccacgtccaggtcgcaggggaggggcccgccgcccgtttctaagggcctggctgcattcctgcggtcacgatcaggggtctttgctttctcccatcccctcctggagaaagaacgcagcttttaacgcgttctccttggttgggcacctttcttgggaaagctccgcctaccattgcccttgtacctgtcctctcctctctccctttcctgaagtgactgcccgtctcttgcaccgtggtgtgaatgcgtcgagatctcggcgctgcagcagcatcggagattggatccagcccatggagaggtccccagagtccatttgtccgtccccagggcaggggcctcggaagagcaagggggaggagctgacctagccggctgatctttgtggcttagacaaaatttagagtttatttgtccttctgaccatgatctcagatcagatggacaagattagccttacacttaggagcgttctggtgcaagactagtgacttatttttccttccttcctaccatccttccttccttccgtttttcctttcttcctcctgccctccctccgtccctcccttttttccttccctttctatctctctctcattttttttttttttttgacagggtctcactctgttgctcaggctggagtgcaatggcaccatcataactcactgcagcctggacctcgtgggctcaggtgatcctctcacctcagcttcccaagtagctgggactacaggtccacaaaaccacgcctggctaattaaattttttttttgtagagacagggtctcactatcttgcccaggctggcctcgaactcctgatatcaagctatcctctctccttggcctcccaagatgctagaattcccggccatgactttttttttttccttcttttttaacctgaagctctatcccttgtcagtaaagccagcagctaatgtttcctgtctcactgtgtggagcaaatctgcagccctgctgtcatagctctattgtgaggatctgttataccagcacctgttaacttgcttggcatttggagaagctaggtaaatgttgtgtgaatgaataaatgaatgaacccagccaagtatgtcccatgagccaagtacaagaagagtggactcttgtgctactcacactctgccttcattgttaagaaaggcgcatttttctaaccaaggcataaactccaagagtggatacaatggacgggttagccacctgttaagagaagtggaagttaaatgattcataacattttgatttcaatctgctgtcccaccattatcaggtgtatggccatataaagaaaatgaagttggggccaggcacagtggctcacgcctgtgatctcagcactttgggaggttgaggcgtgcagatcacttgaggtcaggagtttgagacaagcctggagattatggtgaaaccctgtctctactaaaaatacaaaaattagccaggccaggtggtactcacctgtggtcccagctactcggagaggctgaggtgggacaattgaggtgggacaattgcttgaacctgaggtggaggttacagtgagctgatattgagccacagcattctagcctgggcgacacagtgagactccatcccccacccccccaccccgcccacacacacacacacacacacaaaagaagaaaaagaaatgaagttggattctttaattgggggacaagggtttagataatccgcagcatggactttgagatagcttatgtttggggtattttctttcatacatttagtctcctaattatgtgatcaggctaatttttaagtactgagtaatttttaggagatgttgagactaagttgaaagaaaacctagcccctgtgcaccatgagcctagagtttagagctgagttggcatagtcaactatgaaagctgttgggacagtggcaatgttgaaattcgtaagaagagatcattgtgaactggatattgatgcaggatgccttagaaggtcatgggttaggccttgaaagaatgtacaagaacaaaggaattgggtgttattttatttttaaaattttatttacttttgagtcagggtctcactctattgcataggctgcagtacagtggcccgatcacaacacactgcagcctccatctcctgggcttaagtgatcctcctgcctcagcctcccatgtagttgggactacaggtacgcaccattatgaccagctaatgtttaatgttttaatattgaattttaaaaatttttgtaaaaagagcattggaaatgatttatttccaagattcatgatcgcagacaatgtgtggtcagcaagtggttgtaaagcaaatctgttttctccatgtgactggaaggaagaaacactgacagaagagtgagttctttggcttcctgatcctggctgagcctgtcagtgcttctgtcccctccttcttggccagtggccgtgtctctggacagattctgttcttagaagggtgctggtgagccagagatgacatatatgcagaagtaggttttgaaaaagttcagtgtcaggccgggtacagtggctcatgcctgtaatccctgcactttgggaggtcaaggagggtggatcacttgaggtaaggagttcgagaccagcctggccatcataatgaaacctcatgtctactaaaaatccaaaaaattagccaggcatggtggcaggcgcctgtaatcccagctaaccgggaggctgaggcaggagaatcacttgaacacaggaggtagaggttgcagtgagccgagatcaagccactgcattacagcctgggtgacaaaaagcgagactccttctcatagaaaaaaaaaaagatgaaaaagttcagtgtcttggtaccagtaccatgctgttttggttactgtagccttgtagtatagtttgaagtcaggtagcatgatgcctccagctttgttcttttggcttaggattgacttggcgatgtgggctcttttttggttccatatgaactttaaagtagttttttccaattctgtgaagaaagtcattggtagcttgatggggatggcattgaatttgtaaattaccttgggcagtacagccattttcacgatattgattcttcctacccatgagcatggaatgttcttccatttgtttgtatcctcttttatttcattgagcagtggtttgtagttctccttgaagaggtccttcacgtcccttgtaagttggatttctaagtattttattctctttgaagcgattgtgaatgggagttcactcatgatttgtctctctgtttgtctgttattggtgtataagaatgcttgtgattcttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagcttttattattttgagatacgtcccatcaatacctaatttattgagagtttttagcatgaaaagttgttgaattttgtcaaaggccttttctgcgtctattgagataatcatgtggtttttgtctttggttctatttatatgctggattacatttattgatttgcgtatattgaaccagccttgcatcccagggatgaagcccacttgatcatggtggataacagagatatagatcaatggaacagaacagagccctcagaaataacgccgcatatctacaactatctgatctttgacaaacctgagaaaaacaagcaatggggaaaggattccctatttaataaatggtgctgggaaaactggccagccatatgtagaaagctgaaactggatcccttccttacaccttatacaaaaattaattcaagacggattaaagacttaaacattagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaataaactaccatcagagtgaacaggcaacctacaaaatgggagaaaatttttgcaacctactcatctgacaaggggctaatatccagaatctacaatgaactcaaacaaatttacaagaaaaaaaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacagtgagataccatctcacaccagttagaatggcaatcattaaaaagtcaggaaacaacaggtgctggagaggatgtggagaaattggaacacttacagtgttggtgggactgtaaactagttcaaccattgtagaagtcagtgtggtgattcctcagtgatctagaactagaaataccatttgacccagccatcccattactgggtatatacccaaagaactataaatcatgctgctataaagacacatgcacacgtatgtttattgcagcactattcacaatagcaaagacttggaaccaacccaaatgtctaacaatgatagactggattaagaaaatgtggcacatatacactgtggaatactatgcagccataaaaaatgatgagttcatgttctttgtagggacatggatgaaattggaaatcatcattctcagtaaactatcacaaggacaaaaaaccaaacaccgcatattctcactcatagatgggaattgaacaatgagaacacatggacagaggaaggggaacatcacactctggggactgttgtggggtggggggaggggggagggatagcattaggagatatacctaatgctaaatgatgagttaatgggtgcagcacaccagcatggcacatgtatacatatgtaactaacctgcacattgtgcacatgtaccctaaaacttgaagtataataataataaaaaataaaataaaaataaaaaagaaaaagttcagtgtcctagaattggactccccatggctgcaaactctcctgggagccactgtaagccatgtgtctgtgggtgtacacacagagtgtacacacaatgtgatagtaggagtaatatctcagggtgtacagccactgtgatattatgaataatatcacagggtgtacagccacttaatattgatattaagagtaatatatcccttcaatatatgaataatatatcccttaaatataagaatagtataatataataataatatatgaataatatgaataatatatgtacaccccctgtgatattaggagtaatatctcccctagatattatgaacaataccacagggtgtacaccctctgtgatattaggagtaatatctcccttatatataaaacgaacagtaccacaggtgtacaccaactgtgatattaggagtaatatctccgttatatattatgaataatgtcaaagagtgtacccccactgtgatatgaggagtaatattacccttagatattatgaataataacacagggtgtacatccaatgtgatattaggagtaatatctcccttatatattataaataatgtcaaaatgtgtacccccactgtgatatgatgagtaatattacccttagatattatgaataataacacagggtgtacatccaatgtgatattaggagtaatatctctcttagatattaggaataatatcacagggtatagagccactgctatattagcattaagatctttcttagatattatgaataatatatcacagggtgtacacccactgtgatatgagaagtaatatctttcttagatattacaaataatatcatagggtgtacacccaccatgacattaggagtaatagctccctgagatattatgaataatatcagaaggtgtatacccactgtgaaattagaagtaatatctcccttagatattactagaagatattacttctaatttagtaatatctcccttagatattacttctaacttattaatatcacagggtgtacacctactgtgatattaggggtgatatctcccttagctattatgactattgtcacagggtgtataaccactatgatattaggaataatatctcccgtagatattacaaataatatcaaagggtgtatatacagggtataaacccactgtgatattagtagtaatatctcccttagatattacaaataaaatcacggggggacacctactctgatgttaggagtactatctcctttagctattacaaataatatcacagagtgtacacctgctgtgatattaagagtgatatctctcttaggtatcacgaataatatcacagggtgtacagcctcagcgatattaaaaggaatattttccttaaatattatgaataatatcaaacgatgtacacctactgtgatattaggagtaatgccttccttagatattccaaataatatgaaagggtgtatacctaatgagatattaagaataatgtctcccttagatactatgaataatgtcaccccactgtgatattgttcataatatccaagcgggaagagcatgatattactgccaatatcgcagggggtgtacaccttcctgtgatattgttcataatatcaaggaggggagaggttgatattaattctaatatagctggggttgtacacatccctgtggtactgtttgtaatatacaaaaggggagaatatgatattattcccaatattgcaggaggtgtacacctccccgtgatattgttcataatgtccagggggcagaagatgatatcactgccaatatcgcagggggtgtacaccttcctatgatattgttcctaataaccggggggaagaggatgatattacacgcaacatcacaggggctgtacgcccccccatcatatagtttgtaatattcagggggaaagaagatgatattactcccaatgtcacagggtttgtatacttctatgtgacattgttcgtaatatccgggggtggggtggggagagaatgatattactcccaatattgcagaggctgtacacccccctctgatattgtttgtaatatttaggaaggagaaaatgatattactccctatatcgcagggggctgtacacccctctgtgatatcattcgtaatatccagaagaagacaggatgatattactcccaatatcgcaggtggtgtacacccctctgtgatattgtccataatatccaggttggagaggatgatattatttcccatatcgcattgtgtgtacacccccctgtaatattgtccataacattcaaggctaaagaggatgatattattctccatgtcgcagagtgtgtacagcctgctgtgatactgttcgtatcatccagggagggagaggatgatatttctccccatatcgcaggtggtgtacacccccttgtgatattgtccgcaacatccggggtggggaaggatattaatccccatatcgcagaatgtgtacacccccctgtaatattgcccgtaacatccagaaggggaggggatgacattacttcccatattgcaaggcgtgttcacccccctgtaaaatagtccataacatccagagggggaggggatgatattgctccccatatcgcaggggaatattgtcccctgtgatattgtctgcaacatccggggcaggggaggatgatattaatccccatatcacagaatgtgcacacccccctgtaacattgtcggtaacattcagagggggaggggctgatattactccccatatcgcagggggtgtacaacttcctgtgatattgtccgtaatatccaggggaagagaggatgatgttcctccccataaacaacctgcgatattgtccataatatccagggagggagaggatggtgttattttccatattgcagggaatgtacaccccactgcgatactgtccgtaataaccaggggtggagaggatgatgttactctttatttcacaaggaatatacacccccctgcgatattgtccgtaataaccaggggtggagaggatgatgttactctttatttcacaaggaatatacacccccctgcgatattgtccgtaataaccaggggtggagaggatgatgttactctttatatcacaaggaacatacaccctcctgcgatattgtccgtaataaccaggggtggagaggatgatgttactctttatatcacaaggaacatacaccctcctgcgatgttgtccgtaataaccaagggtggagaggatgatgttactctttatatcacaaggaacatacaaccccctgcgatattgttcgtaatatccaggaggagagaggatgatgttactccccatatcgcagtgggtgtacacacccctgcgaaattgtttgtaatatccacggggggaggagatgatgttactccccatattgccagtagtgtacatccccctgcatattgttcataatactcagggggagagaaaatgatattactccacatatcgcaggggatgtacacacccctgcaatattgttcgtaatatttgggggggagatgatgatattactccccatatcggagggggtgtataccccactgcgatattgttaataatatccaggggggagatgatgttattcccaatatcgtaaacacccttcgtgtacattttctgtgacattgtttgtaatatccagggtggcagaggatgatattcctcctaatatcgcaagatttatacactctcttttgatgttgttcgtaatatccaggagaggagagggtgatattactccaaatatcatagggggatacaaccccctgtgatattgttcgcaatattcaggggaggagaggatattactccccagatagcagggagggtacactcccctgggatattgttcataattttcaggggtgggagagaatgatattactcccaaaatcacagggggtgtacacccccctgtgatattctttgtaatatccaggggtggagagtatgatattaccctcaatatcgcagaaagtgtacaccccctttgttatattgttcgtaatatccggggcggggggaggagacaatgatattacttccaatatcgcaggggctgtacacccccctgtgatattattgctaatatccagtgggggagaagatgatattactcccaatatcacagggggtgtacacccttctgtgatagtattcgtaatatctaggtggggagaggatgatattacctccaatatcgcaaggcctgtacaccctcctgtgatgttgttcataatatccaagggggtagaggatgatattattccctgtatcgcaggggatgtggaccccctgtgatattgtttgtaatatccaggaggaaagaggatgatattactcccaatatcgcaggtggtgtacacacccctgtgacattattcctaatatccagcggcaggggaaggatgatattactcccaatattgaaagaggtgtacacacctctgtgatattgttcgtaatatccaggtggggagaggatgatattactcccaatattgcagaaagtgtacacctccctgtgatattgtttgaaatacacagacggagagaagatgatattacttccctgtgatattgcttgtaacatgcaaaagggaagaggatgatactactccccatatcgcatggggtgtacattcacctttgacattgttcgtaatacccgagggggaggataatattactcccaatatcgcagcaggtgtacacacccagtgatattattcgtaatatctaggggaaagagaataatattactcccaatatcgcagggggtgtacattctcctgtgatattgttcataatatccagggtgggagaggatgatactactcccaatatcgcagagggtgtacacccaactctgatattgttcgtaatgtcaagtggggagaggatgatattacttccaatatcacagagggtgtgcactcccatgtgatattgttcataatacccgggaggaggagaggatgatattactgtcaatatccaatatcacagggggggaacaccccactgtgatattgtttgtattatccagagggggagaggatgatattactttcaatatcgcagatggtgtatgcccctttgtgatagtgttcataatatacaggggggggaagaatgatattactcccaatatcacagggggtgtacacaccttttgtgatattgtttataatagccaaggtgggagaggatgatatacgaacaatatcgcaggaagtgcacacccccctgtgatattcttcgtaatatccagggggtaacaggatgatattactcccaatattgcagggggtttacactcttctgtgattttttttaatgtcctggggggagagaatgatattactgttaatgtcacaggcggtgtacaccctttttggtgatattgttcctaatatcgagggggggagaggatgatattactcccaatatcgtaggttgtgtacacacagcctgtgatattgttcctaatagccaaagcgggagaggataatattactttcaatatcgcaggggatgtacacttacagagtgatattgctcctaatatccaggccaaaagaggatattactcttgatatcgcagagggggacactcccctgcaatatagggagtaatatcatcctctccccccggaaattatgaacaatatcacaggtgggtgtacacaccctgcgatattgggggtaatatcattttctttccaccaggatattacacacaatatcacagaagggtttacatccccctgcgatattgggagtaatatcatcctctctcccctctctagatattagcaacaatatcacaggtgggtgtacacctgctgtgatattgggagtaatatcatccttttcaccccctggatattaggaacaatatcacaaggggtgtgtacaccccctgtgatatttggagtaatatcatgctctccccctccccggatactacaaacaatatcacaggggagtgtacacaccctgagatattgggagtaatatcatcctctcctctcctgaatattatgaactatattgcagaatggtgtacaccccctgtaatattgtgagcaatattatcttctccctccctggatattataaacaatattacagggggtgtacaacccctgagatattgggagtaatatcatttcccccccagtggatattataaacaatatcacggaggtttgggccccctgggatattgaaaataatatcatccttccaccccctgaaaattatgaacaatatcacaggagagtgtacactccctgcgatatgggaagtaatatcattttctcctcctctggatattaggaacagtataacaggagggtttacacatcctgccatattgggagtaatatgctctgccaccctggatattacaaacagtatcacagaggatgtacacacagaatgtttacgatactgggagtaatatctcccccccatccggacattacaaacaatatcgtagcgggtgtacacccccctcgatatgaaaaggaacatcatctcctttccctgtggatattatgaacaatatcacaggggtgtgtataccccctttgatatggggagtaaaatcatcctctccccccttggatattatgaacaatatcgcagtggcatgtagatttcctgtgacatgaagagtaatatcgtcctctcgccccctggttattacggacaatatcacaggggggtgaacgctccctatgatgtgaagagtaacatcatcccttcccccctggatattatggacaatatcgtaggggggtgtacaacccctgggatatggggagcaacatcattttctccctccccggatgttaccaacaatatcacaggggggtgtacactccctgggatattgggggtaatatcatcctcttttcccctggatattacgaacaatttcaccgggtggagtacaccttctatgatattgggagtaatattatcctctccccttatggaaattgcgaacagcatcccggaaggtgtacattccctgcgatgttcggagtaatatcatcctctcctcactggatatttggaacaatataaaagggggtatacaccccctgcaatagttggaataatatcatcctcactccccttggatattatgaaccatatcacaggggggtgtacgccccctgcgatactgagagtaatatcatcctctaccattctggacattatgacgtatatcacaggggggtgtacaccccctatgatattgggagtaatatcatcgtcttccccgtggatattaggaacaatatcacaggagggtgtacaccgtttgtgatattggtaataatatcatcctctcccccttcaggatattatgaacaatatcacaggggggtgtacacccactgcgatattgggagtaatatcatcctctccttccctgaaaattacaaagaatatcatggggtagggtgtacaccttctgcgatattgggattagtatcttcctctctctccctgcttattacgaacaatataacaggaggttgtacaccccctgcgatattgtgagtaatatcatcctctcccttcctggatattacgaacaacttcacagggggatgtacaccccttgcgatattagtagtaatatcatcctccctcccggatattcccaacaatatcagaagggtgtgtacaccaccttgatagtgggtgtaatatcttcctctccccattttattactacaaacaacatcacaggggggtgtacaccccctgcaatattggaagtagtatcaattggaagtgaacaacccttgcgatattgagagtaatatcatcctaaccccttgtggatattacaaacaatatcactggggggtgttcacacagcatgtttccgatattgggattaatatcatcctttcctcccctggatattacgaacaatatcacaggggcctgtacaccccctgggatattgggagcaatatcatcatctctccccatggatattacaaataatgttacagggggatgtacacccctgtgatattcggaataatattgtcctctccctctctggatattatgagcaatgtcacagggggctgtacaccctttgcgatattgggagtaatattattttctccccttctggatattacgaacgatatcacaagaaggtgtacaccccctgcgatattgttgagtaatgtcatcctctccccaccccggatattgcgaacaatatgacaaagttgtacactccctgggatattgggagtaatatcatcctcttctcccctggatattatgaacaatgtcacggggggtgtacacccctagcgatattgggagtagtatcatcctctcttcccttgaataacgcgaacaatatcagaggggagtgttcatcccgggtgatattgggagtaatattatccgttcccttcctgaaaaatatgaacaatatcacagaaggtgtacacccctgcgatattgggagtaacatcatcctttcccaccctgagtattatgaacaatatcacaggggggtgcacaccccactcgatattgggagtaatatcaccctcttcctcctagatattacgaacaatatcacataggggtgtacaccctctgtgatattaagtgtaatattatactcttcccccttggatattatgaacaatatcccagaggggtgtacacctcctgcgatatggggtgtaatagcatcctctccccttttggatattatgaaaaatatcacaggggggtgtacaacccctgtgatattgggagcaacataattctttcccccctggatatttcaaaaatatcacaaggggatgtacaccccttatgatgtttgtagtaatatcatcctctctcccctggatattacgaacaatatcacaggagggtgtacactccctgggatattgggagtaatatcatcctctttccccctgtatattacgaacaatatcacaggggcgtgtacaccccctgcgtattgaaagtaatatcattcacttcccccctggatattgtatatcatatcacaggggcgtgtacaccctctgctacattgggagaaatatcatcgtctcctcccgtggatattatgagcaatatcataggggaatgtaccccgcctgcgatattgggagtaatatcctctcccaccctgaatattacaaacaatatcataagggggtgtacatcccctgcgatattgggagtaatatccttttccaccctgaatatcatgaacaatattataggagaatgtacaccacctgcgatattaagagtaatatcatcctttccccccatggatattacaaacaatatcacagtgttgtgtacaccccctgtgatattgggaataattttatcctctccccccgctcgatattatgaaaaatatcacaggaaggtgtacattctctgtgatattggcagttatatcatcctctgttctagttaatattacgaagactatcacaggggtatgtacacctcctgagatattgggagtaatatcatcctatctccccctggaaattaggaaccatatcacaggggaatgtacataccctgcaatattgggagtagcatcatcttaccctcccctgctctttacaaatagtatcacaaggggctgtacaccctctgcaatattgagagtaatatcatcctctcttcccctggatattacgaacaatacagcagggggtgtacacacagggtttttatgatattgggagtaatatcattctctccccaccctggatatttcgaacagtatcacaggggttgtacactccctgcgacattgggagtaacatcatcctctccttctcttgatattacgaacaatatcacagcagagtgtacatcccctgcgatattggcagaaatatcaacctctccctctctggatattaccagcaatatcatagggggttgtacacccccttcaacactgggagttatatcatcctctcctcccactggatattatgaaaaatattacagaaggcgtacacacagggtgtttacgatattgggagtaatatcatcttccccctccctgaatattatgaacaatatcacgggatggggtacatcccctgtgatattgagagtaatgtcaccctctcccttcctggatattataaacaatatcacaggggggtgcacacccctcctatatagggagtaatgttatcctctccccctccctggatatttcgaacaatatcacaaggggaatgtactcaccctgcgatatggagactaatgtcatcctctccctccctggatattatgaataatatcacaggggggtgtgcactctctgtgctctggggagtaatgtcattctctcccctataaactaaaattttgttctctttacctaagcccagagcttcctatcacgtcagtatctatgttatgaagaaaaggagacttaggtgagatgtttttatttatcacaactgctgcatcaattgcctaggacctcaacagcttcatgaaagtctgggaaatgttcatgcataaggttattgccttagctgacttcaaattgctccatacaatggtacatataaacccttagtgaagccttttaaaaaacaaacaggttgaaaaatgggttaaagtaggcaaatacagcatctgcctttagggctatcaactgaggaattctctcaattatgaaatcttgcagagaagttattttctttctcaaaatccaggtgatgaaatatttcttactccagatctggcattttttcatcatcactgtcttgtgaatcatcacctgcttcatctacttctggtaaatctacatcctcatccccacccatgttgttcatcatctcggagaaacgatcaaaattagacctgtcttcatctgaaccatcttcccagtctttccaatgattgaagtccatactaagccagttaagctttgccctttcttttgttaaccttggccatgactggccagattctccttttcgtaaacaacataaaattgatctgtccgttcttttatgcttggaatcatttggatcaatagagtaaaaaagaccaatttcatttaaatgcttaaaattatcacttcctccaagacaactgaatgtaagtttggatttttcaaaatttacattaacatccttattgtcttcaacacaagattcagtgaagacacagtcccttcgatcgtaccactttgcaaaagcaggctgcattgtgaatgcggcagggggacgggcgaacgggtgggcgggcggctgtctggcggcggctgctctccggtggggactccgcgttttctccctggtcgccgctgcctcttctcgctcccctcaggcgacggcggcagctacagctgcttctttatacgtttttctgcttagatcagggaaaactggctggattaaattagccacaggagggctccactgcagtttctggaaaagaaaattctgcagtcatactttctggtacacagttgtatctgtgcagtcttcaatcggccacgcctatttataaacgtgaaagatgaagccagggtggccgggcacgatggctcgtgcctacaatcccagctctttggaatgccgaggcgggaggatcacttcaggtcaggagttcgagaacagcctggccaacatggtgaaacccctgtctcaaccaaaaaatacaaagattagccgggcgttagtggtgcccgcctgtgatcccagctactggggaggctgaggcagaaggatcccttgaaccccagagaaggagattgcagtgaactgagatagcgccactgcactccagccatggcaaaaagaatgaaactccgtctcaaaagaaaaaaaagaagccagggcaggcaactcaggtaccttttggacgtccattaacaaaaattcgagagaactttctggaaacctagagtatatttctgtgggaaaaacacaaaattgagacttgaaatgataagctctgatttgttcatttttttaatcttaaacatttaaagtttcacagcaacagcttatattcagggtatgcaatttataggtagctaatgcatgaaaaatatgattacagttttgtattacccattatttttctcttgtcaaccacaaagaatttcattattatctaatctgtggcccagatgctgcctgtctttgtttcatctataacagcatttcctatcatgtggctacaggataataattgtgattacaaaaagaaaaaagtacaggaactcacaggtgaaacagagctgaacacaacttttacagaactcatcagctcctcactgtaaatctcctagattggcctctcatgtaccttttttttttttccttttttccttgaaacatttgctgctctttttagaaatcacaaacagggtttcaaaagttatttaaaaaaaaaaagcctgaagaaagaatccaaaatttgagaccatacctattctaagaagtggtgaaaaccacatggaaaaatatcaagtagtttgtgtctaatgctttcagaattccctcttgtactttactcacaggagaagttataggaacccctacaggaattacaatgacagggccagacccaggaacagcctgcacactcgagttttgaagttttaactcattctctctccagctgtctcacacttgttgtttgttgttttgttcgtttctttctaatttagaaaaaaaaaaagtagtagtcagggagtctagtcaaatacatcggagttggggggaattattagatacccaaatcttagtgatgcatttgactatttttcgggatgaaaagcatatatgggtagacattggcttggaggggaaatggtgacacaggagagatgaaggagcagcactttgaagttgatttttgaagaaaaaccattagttttcatcattgtataaggacatcactctatgaatcatagcaataggcaatttgcaatttaaaaaataaataaaaaggcatccttgtggctaaatggcagtttagattacagttcctaaggcccactgaaaatcataagctactgtctttcctgagcacataaatgaatttttcttccattttgacagctctatccctccaggtcatccagctattttatcccttaatattggctactcttcctcctctctcagacgtctcactttttgcacccagcccccaaacacactaaaagattaaactcaagcagccttccctattgggaaacctttttttttttttttttgagacagagtctttgctctgtcgctcaggctggagtgcggtggtgccatcaatctcggctcactgcgacctctgcctcccggcttcaagcgattctcctgcctcagcctcctgagtagctgggattacagggacacaccaccatgcctggctaatttttgtatttttagtagagactgggtttcaccatgttggccaggctagtctcaaactcctgggctcaagtgatccacctgcctcagcctcccaaaagtgctgggattacaggtgtgagccactgtgcccagccccctactggagacttttgatgggcatttttatttatctaattacggaaaaggaaagtaacaaaaatgaactgtgcagatagagactctcctcatataggagttgttagatcaaatcctgcttccaaaataaagaaataaagaggtgaaatgaagacagggttgagctgaagaaaatttcatgcagttagcactaggggaagtgggagaacatagatggaagcagcacctactggatgtgctcttttgtgaaaggtgcttaatggctgctcactttggagatgactgagtccaaactgcctcatctaattcttcaagtcatcttccatctgcctgttaagcagtaacaggcctcctgagattattcccttatgtcaaaatgggatgtcatgttaatccacaccatgaccattttgtatctttcttccctttgttttccagtttataacactttccacctctacctctcattctggaaaattctcccatgctctagacttgaatctctgatacttcacctcccacttatgtgaacttgggcgtgttacttgatattgctatgcttcaattttcttatgtgtaactgcagataataatagtccctacctcataaagttgttacagagattaagtaataatatgcatgtaaaacatcgattgagctattattacacagcctttaagattcaagttcaaatcccccttccaggccgggtgcagttgctcacctctgtaatctcagcattttgggaggccaaggtgggcggattacctgaggtcaggagttcgagaccagtccggccaatagggcgaaaccctgtctctactataaatacaaaaattagcagggtgtggtggcgggtgcctgtaatctcagctactcaggaggctgaggcaggagcatcacttgaatcctggaggtggaggttgcagcgagccgagatcgagccactgcactccagcctgggtgacagagcaagacaccatctcaaaaaaacaaaacaaaacaaaaacaaaaaaccaaatcccacttcttcgtaaagtcatctccaatactccccaatggaaagggcagtttccttcgctgatttattgtagcacttactgtcctcacggacaacaaggcccttagcatacatggtcttgtggtctaattgtgtacatcttttctcatctgaactacagggaaattttttggatggtagggagtgtgtcttcttgcagtatctagcacagtgttcagcatacagcagatatttaataaataattattaaatcaaaaagtcaaatggatattttaatgaattggttgaatgaatcaatgatttagggggtcaaagccagttttgcaactcttaattcattgcccacatgaaaggcataaaagtgtctggcatcaattagaatggctgaagaggatttttggagaattcagtccctgggaaccagaagcacctaagtgagggggtgtccagttgtgggagtggaaggccagaaatgagagagagaagccacaagcctcctgttcctgtgcagaccttagctgagagggaagactttaacttttaatgaagattacagttttacttattgcactagactggacatattcatcactgaaccgagactaatttttaatgatgacatcatcggaagactttttgttatttgacagtgactaagagctaagtgattcatcttagtttttatctgaacagtagaggaagaaccagcccaaaagatggattcgaatggccaagtgagaaaacaacattgtctcctcatttcatctcaggagccccactgttaatgcaatggtgtcatgaggttgatttagtgtctgcggatcctggcctgttggacagcaggcaggaatgcctggaatgccaggcagaggtagaagtgtttgtagggagaggaataaaactatcaaagggaagcagaggtcatgaaatgatgacctgctcctggcagaaaggggaccctgccacgtagccatcagctcactcccatccacctttgttttgttttttgagacagagtctttctctgctgcccaggctggagtacagtggcgtgatcttggctcaccacaacctccgtctcctgggttcaagcaaatctcatgccacagccttggttagcttgagtagctgtgattacaggtgcacaccaccacatccagctaatttttgtatttttagtagagatgaggtttcgctatgttggccaggctggtctcgaactcttggcctcatgtgacccacctgccttggcctcccaaagtgctgggattacaggtgtgagccactgcacccgaccccatccaactgttttgattgctgcacagatgtggatgcttctgctggtcatcatctctgcttctctccctctagaggcctctcatctccccctgcaaaactgccaacctgagttactgcccagtttttcttcttgggccccacagcacaagctgagagtatgcacctggatttactaggctctcaggagagttctgattctttcaaatgtccattagattgtttgtttttaatgtttctattgggatgcaattgtcagttgtgcttctgcacaaacagaaccccttttattccatgggatattttcagagaagtcatcgcgcagtatctttcacagaacgaattgctcttataaccggtttgcttacaggacacacctgcagctggcaagccttgagagtttaccatttatagaagctgcacctgagatccatttggactgctgcttgcaaattattacatgtgaaattatgaactctaacttaagcgttccttggaattgtcttaggaagagaaagatgcattttgatggctggggaaggtaggaaccaagtagacttgttttctttttgtttttttctgtgttttttttttttttttttttgagacagagtcttgctctgttgcccagcctggagtgcagtggtgtgatgtcggctcacttctacctccatctcctgggttcaagtgattctcctgcctcctgagtagctgagattacaggcatgtgccaccacacctggctagtttttgtatttttagtagagacggggtttcaccatcttggccaggcttttcttgaactcctgatctcatgatccatccccgtcagcctcccaaagtgctgggattacaggcgtgagccaccatgcccagccagacttgtttatttttaatgcccagggacttggggtaataaaaaatcaggtttggctatagcatcataacagcaactggtcccttggccacatgtagaaaataaactgggatgtttgttttgtcacctgtctgcctttcccctcctctgtgccttattgccgcttcccactgcctcccatcagtccccactgtagagtcctgccacagtttgtacattctgcatagttggcccctattttggacttttctgcccttttatgataactaactagtgctaagagaagagctaggaaatctgacatataagtcaagttataagcggatgttaatggctgaatgcatgatgtttggggctcaagagaattgtttttaaattgcactgaggttgggcacagtgcctcacacctgtaatcccagcactttggaaggctgaagtggaagaatagcccaggagtttgagattagcctgggccacaaagcgagaaccccatctctacaaaaattttaaaaattagcctggcataatggtgtgtgtctgtagtcccagctactcaggagactgaggcgggaggatcgcttgagcccaggagtttgaggctgtagtgagctatgactgcaccactgcagtctgaatgacagagtgatactctgtctcaaaaaaaaaattttttttgctaggaaaaataaactttggaagatgcctgtttagtaaaggtctcagctagaatcagtacaccaagaaatttattcttactgggtatttgactggaagagagtcgtttctgtgcacatgttgttggtggaggggagagggtctgagggaaaaataggaatgccaagggatgaattgacatttgttaagcagtagcgtttcagtgcacagattctactgccagagggcctggggtcatgtcccagttctaccacatagcagctggtggcaacttcagacaagttgcttaatctcctgtacccaaatttcatttccaaaatggggatgttagtagctcaatgcctctcaggggtgttttgagttaatttatgtagtctacttagcatatacatggcacatatgtgctacataagcatcagctattaatactcctaagtgtttctgcagcccacttggatgaactcctttctgagccaggtaagaagaggggctgcaggagggactctgtgagacccagggacatgggagcactgtgtttattcctaatagaaaaagtatgacccagagaaaggaaaagaacattgatatggtttggttgtgtccccactcaaatcttaacttgaattgtatctcccagaattcccgcatgttctgtgagggatccagggggaggtaattgaattatgggggctggtctctcccgtgctatcttgtgatagcgaataagtctcacgagatctgatgggtttatcaggggtttccgcttttgcttctttctctcattttctcttgctgccacgatgttaagaagtgcctttctcctcctgccatgattctgaggcctccccagccatgtggaactgtaagtctaattaaacctctttttcttcccagtctctggtatgtctttatgagcagcatgaaaacggactaatacaaatgttctgcaccaggctttagaacctccagggtttctgtctttgggaacctcaggagacagtgcagatttcatggagagacagagactagcaccaatactgttggtaaggcaactagtgcccatgagagtaagtgaaatggaagaacatgagaggcgtgttttgtgcacataggagccatctcctaggactcttagaaatacttaagggggactcttcatgggaccaagccctgtattgtaagaggaataataggaatgtgtttaacctgagttataatctgataggacctatcagtatgcaaaagctagcaaggctagtcatacaaatacaagagatcttattaaatctgttgactcggaggaagtctccttgggcctcttgcttgcatttcttttcttgctagctgtttttttcttttttcttcctccttccttgtctgcaaagttgtttcctgaatgtctaggttttaaacatattttggtttcatccatggaaaccagaaaccaggctggggagctatttacttcttgccgttctactcggggtttggaattctttcttgtggatgctgtctcaaagctacctttcttgctctccatgtgcaatattactcattaataaaatcatggaaaatgctgacacggatatcctcaggaaaaccaagatagcactggagcaaggactgaagcccctgtgcttgctgatgatgtaatatacttgagcaggtgccatctcaatgttagataagcgtgaaaagacctggccatgcttctctcacatgttccttggtgaatggatgggctggctcttagtgcttaaggattgattgcctcagtcgtggcagacctatgatcaacatcttcaagtttagcactcagttgctctaaataattacttcatatgtactagtcttatctttgcagataggtgatcatttctttggtatttctgcagtgtttagcagaaaccagaacataataaaagcttaataaatatttaattgctactgtaagaaagtagaacaatggagcaaatattttcttatttcagctcatatagtactcacatccttcttgctcatatgcaatttcaactgtgagaagggatactccactcacttcttaattcctccctttggcatgtggctggtatgggttttttacatactagggtaaatatggctatcatgtcaatagtactgtcacaaggaatgaggaattacaccaaagctgattgcaagaaagaaagctcttaattgttaaactcagatctattgtgaaccagcaatgatggtgaaaatatgcagaatgcagtgacaatctaatgggctggagtaacataagactaatgcatcaaaatgaacatgtggtagaacagaatgcagaaattaaaaatggctttacacatgcctgtaatcccagcactttgggaggccgaggcgggtggatcatctgaggtcaggagtttaaaaccagcctggccaacatggtgaaaccctatctcgacttaaaatacaaaaacatagctgggtgtggtggcagatgcctgtaatcccagctacttgtgagaacgaggcaggagaatcacttgcacccaggaggtggaggttgcagtgatccgagattgtgccaatgcactccagcctgggtgacagagcgagactgtctcaaaaaaaaaaaaaaaaaagtcctaacagatggattcttattaatttacacaataagtgtacctcattgcccatccccactctcattttgttgggagcaatcttttgctaaccatgcaaatattagacatttacttgtataatttcttttgtgtatttttatacacactacattttgagaatgcaattaggaattgggcttttgctcacaattgctctcttttactgcctcgacacagacgttattgttaacagtggctactctatgaggattgtgccttgctttttcaaatgttgaacacaatgctaaattaaatgagcaggccacgcaattccttaaccacaaaggctcttcaccttcctactcctctccttcccctcaagtgctccttctcagtcctttttttttttcttttcagatttaacagtcctgatttagcagatccagagctgctgggacctcccaacacccatctcagagtatatgttatttggctagggttgccataacaaagtaccacagactgggtggcttaagcagcagaaatttattttctcacaattttagaggctagaagtccaagaacaagtcgtcagcaggtttggtttcttttgaggcctttctccttggctttcagatgttacattctcattgtgtcctcacatggtcatccttctgtctgtgttctctgtgtcttaatctcctctttttcttcttcttctttttttaatttttagtgggacagagtctcactctgttgccgaggctggagtgcagtggcacaaccttggctcactgcagcctccacttcctgggtttaagcaattctcctgcctcagcctcccaagtggctgggattacagatgcacaccaccttgcctggaaaatttttgtatttttagtagagatggggtttcaccatgttggccaggctggtcttgaacttctgacctcaagtgatccacccaccttggcctccccaagtgctgagattacaggcatgagccactacgcctggccttaatctcctcttcttataagaataacagtaatattggattgtggcccacacttaccaacccattttaatgtaattacctctttaaaggccttatatccaaatacagttgttaatggaaaaactagactcttaaaatattataaacaggtttattctgagccaatatgagtgaccatggcccagggaacagtctcaagaggttctgagaaagtctgcccaaggcaattgaattacagtttggttttgtacattttagggagacaggaattgcgggtaaaatcataactcaatacatggaaggtgcacattggttcagcctaaagaggcagaatatcttgaaagagagattgtttacaggtcgtaggtggattcaaagattttctgattgacgattgtttgaaagagttaaagctttgtctaaagatgtgaagtcagtagaaagaaatgcttaagataaggagggttgtggaggccaaggttcttgttatttagatgaagcttcctaagttcatctaggaagcagccttcagagaaggcttcaggtgaagcagccttcagagaaaataaatggtaaatgtcttttcagaccttaaagttgtcaggctttcagtttatctctcctagatccatagagaggcttggaaagagaagtccagtctgcgttaatagagattctctaaaatgcaaatttcccccacgaaagatgattttgcagggctaattcaatctattggccctgtggcagacatttcaaaatatgtcaaagaaatatatatatatatatatatatatatatatatatatatatatacatttttttttctgagacagagtctcactctgtcgcctatgctggagtgcagtggtgtgatctcggcttactgcaagctctgcctcccgggttcaagtgattctcctgtctcagcctcccaagtagctgggattacaggtccccaccaccatgcctaaataattttttttgtgttttgtagagatggggtttcaccatgttggccaggctggtcttgaactcctgaccttgtgatccgcccacctcagcctcccaaagtgctaggattacaggtgtgagccactgcacctggccaagaaatatatttgggagtaaaatattttcatttccttcaggatctgctgtcacgtgatgctataccagagtctgattggaaagtaagccacattttactgggttaataaaaacctttctaatgagattttaagtcttcccttgtaaccttactctatctgaatgggagtggactgaggaggagctacttgctagactagcattgctgcctgcaatctagaccagcagagtggtgattctaatgtcccttccaaggtagaaaagtttaagtattaatgaaggaaaggagaaataatagcagagggtaaagggatgaataaatggggtatacacggaaggaaatgaaacattatattaacactttgaaagaggcttacagcaagagatgacattgtctcttagctcaattataccagatgcctgaaagggtggagctattggtttgccaagaccacttctgcttttggaacctgacaaaattaaaaggaaccctgcaaacctgagtcccctcagcctgggaggcattcatacaagatgatggagtggactcattagtaatgactatgtacatattttttgatgtacagtatccatgattgaaaatcaggtggtggtctgtggttatgatctatattgtccatggttcttggctcataactccctcagcccttgttacagtcttttgttataatgttggatgtgtcgggcctcaggggacagaatctttctgaatctttcagaatccttcacctgcctcaaggcagaactctaatctttccccaactttctgattgtgggtcttaaaaacctccccagagagtgtcctgcctcataccctgagggaagtaatattgaagccacgaagcttccatataaacccaagaggactaggttcagggagcttctggatagctggacatgtggaggttcctggagggtgacacgcccaggaagggcacggaagccctgtgcatgcatactccataccttgccccatgcgtttctttatctgtatctttcgcaatatcctttataataaaccactaaacattaaacgtttccctgagttctgtgagccactccagaaaattattcgaacccaaagaaggggtcatgggaactccaacttgaagccattgggtgagaagtcccagaggcccagacttttgactggtgtctggctggagggtggctgtcttgggaactgagccttcaccttccctattcttaattattagactagtggttttcaatgaaggcagaacagctcctgttagcattttagaaatttgctggaagcttttggttgttacaatgattggaggttgctactatgcatctgattatttctgtagcatctacatattgaattacatgttaaaaaattacaactttgtgatatttttatataataagaaatatatatttggtttttatccctgattcctaacctagagttccttaaaccccttgtaatttccctggtgataggagtgataggagcatctttggttataatatttggtcttagtccctggtttctaaaacaagagcttcaaagagccttggactctctggaatgataagagtatattttgtatgctaataagatgactgttagctggtgacctttcggtagctgatatggtttggctctgtgtccccacccaaatctcatcttgaattgtcacctccagatgttgtgttgagggagggccttcgtgggaggtgattggatcacggggtgggttcccccatgctattctcatgatagtgagtgagttctcacaagatctgatggcttaaaagtgtttggcagctcccccttcactctctgtctctctcctgccaccatgtaagacatatcttgcttcctctttgccttctgccatgattgtaagtttcctgaggcctcccagccatacagaactgtgagtcaattaaacctctttttcttataaattacccagtctcaggcagaatctttatagtagtgtgagaacggactaatacgttagcttcatgatgggagctggttgccagaaagacaaaggcatgattacagggttagaactttcaaaccctccttggcccatacatatccctctggggaaaggagaagagctggatattgagctgatcaccaatggccaatgatttgatcaatcatgcctatgaaatgaaacctccataaaaaccctaaatcacagagttcagagagcttcctggttggtgaacacattaaggtgctgggagggtggtgcccccagaggggacggaagctccatgtaccccaccccataccttgccctatgcatccctccatctggctgttcatctgtattctttataatattgtttataataaactagtaaatgtaagtaaagtgttttctgagccattctagcaaattattgaacctgaggagagcattgtgggaatcccccaattttatagccagtcagtcagaagtatggatggcctagtcttgtgattggcatttgaagtcaaggcagtcttgtgggataccgttcttaacctgtgagatccgcacctagtctgggtagttcgggtagacattgacttgaattgttagaaacccagttgatgtcaggatgaaatcacctttgcaaagattataacaatgagtgaaatctgacatggctgattccttcttgcttctagcctcacaggctggctgtcttcactcattcctgggtataaactaagctaaccatgggatgtatttatagtttaattttaaggcaaggataataacagtccctccctaaaactgatcctctccttgttcagggactaaaactgcttttgtaaagtaatgaaaagccacaagacgtaatgaaaagccacaaggttaagattatggaaggggcttgaattctgctaaaatgtgggcatgccttctataatccttactactcaggagtcatattgtagatcatagtagcaaacatactttctttttatgttttataccagtattaaggcattatactggtttttagaattttaagtaattatattccctatgaattttatatcaaaattgtaatgggggtattacaaagtcacgagatttgtgagtttcctcaattgttcctataaacatcagattggtctttggaggtgtttttcagactgaccctacccagactcatgactcatgactcaactggtcctgtagtcccccacccagaggtggactcagcacacaaggactgttttccacaaccctgcactgcatccttaaccaatcagcagcactcattccctagttccctgcccaccctaacctatgggcctcggggagacggattgaatcataactccagttctcccacatgatctgccttgcgttcattaaattctttctttactgaaatcccatggtttcggtgaagtggttttgtttgtgcagcagacaagaagaacccatcaggcaattatggggagagttggagaattgattgttggtgtggaagaaatacacccatttggtgtctgagtgttaggagtagaaacaggtcacaggagcaaatttgctttctttttgtttatgttttatgctagaattagggctctatttttttaaatttttatataatacctatgaattttatatcaaaattgtaatgggggcattacaaagtgtttgttttaaaaagaaatgttggatttgatagggttgagactctgcaccagatgttaagctgcttaaaggcaggaatgtctcttatccttttttctttttccaactctaaatcatctatggtatgtagaatgtgttcactatatagctgtttattaagtgaatgctttacttacatcttcttttattttcatcattgtagaaatgcggaaaaaggaaaaattttaatagctctatatcacagttaatgttttcaccgatttctgcacacatttcaactattcactatgcattaataaatacaataaaaggcacaaggaaatggatggtcatagagggtgcaggagagccagaagaattcagtgtccagtagcaagagaaagagagaatttgaggaaggttggcagcatcatattcttcaatttttaaaattttttatagagatatttttagcctgaggattttttatagagattatttttatagagattaatttatagcctgaggattgacttggtttgtaatcacttgacattgattctgaatgttcctaactggaaccttttgtaatttcaccccttcaaattccctaaagaaaagaaagataaacgatgattagaagtcagaactaagactctcccatccctcacctctatattttatttatttatttatttatttatttatttatttatttatttatttatttattttgagatggagtcttgctctgttgtccacactggagtacagtggcatgatgttggctcactgcaacctccgcctcctgggttcaagcaattctcctgcctcagcctccctagcagctggaattaacaggagctcaccatcatgtccagctaattttcgtgttttgatagagacggggtttcaccatgttgtccaggctggtctcgaatttctgacctcaagtgatccacccacctcagcctcccaaagtgctgggattacaggcatgaatcactgcactcagccctcacctctacatttaggaaaacaaacaaagtaccccagtttggtagtgtctcaggtaatgttccctggaaagtggactctgagatggaagccagtaggcaggaagtttatcaaggaggattctttggatttacacctgtgggtatgcaggaaagggagcaagagagtgcaagggaaaagttgagtggtaatgatgtcttggcaaagggctcagctgaccctatggggaatgctgaaactgaagccctttttgaattttctcaagtggcaggggctggactttgataccacactttgaccagtcatcagacacaggctgcccccagaaagagggggtgaccttgagtgatttggctcttttagacagaaagtgattcccagagtgctgccagcacccccagcagctgaaggcctgccttcctgaaagggatgctcatcactgtgtccgctccatctcacatctgctcttctgggattctgcttagaaaccagcaattgcacaagagattcaagcttgtgatgttaaatgctataagtaaaatggggtcatgattttatttgtccctcttggacttgtggaatctttctatcttctctttgaggattcagtcttgtttttcttttctttctgaagactaattatgaagaacgagacaaacgtaccaaaatctgaaatggtcaactcaataccccatctaaagcaaatgggaaaacatttgtttcttgccctaaagaagagaattttttcccctttatgggattgagatggtaaagatttctgattcaggctgggagctgtcagaacaaataaagcaattctgtttaaacactttcctttcgtctatctttgaaatgaattaccaaattaagccacctaagtgcactcttaactcttggttctcttcctcatattttgtttcctgtttcatatggaaattatgttttcttctctgcttagtgtcagatgcttctatgggaaattctccaataatgtcctcagatgatctcccacattcaaatgtggtttttctcggctggaaggcgtgggctccttattcaatctcattctaactctcagacaattttagaggctggtgtttcttttcctaaccagaacatgctttctgctttggggccacaaaaatctatttttatttcataccagtgactgaaaactttgtgatacaatgggcatgaaataagcaggaaattcaaaataatattttttatggttttgtgtggcataggttttttccacatatattcacactaagcatctctatggaaaaaaatatatgaattctgattttttacttcccttaatctgttggccagaatgctcaggttatgttactttgaatagaatgtttagaaatggacattccctttctctcctgctcagagtttaagcagttccttgaacaaccaaggtactaaccataaatttcttcattggttggttgtctcttactactcaaaccttaggccctgattttttcatgtttgttctccttgctgtgattttggaaggcagactggtacaaaagagacccctgactgggtacctggcagcttctcagaagggaggcagtggaaactacaggatgcattcctctatgattttttttttttttttttgagacaaggtctcactctgtcacccaggccgtagtgcagcagtgcacttgctgctaactggcagcatcagcctcctgggctcaagcgatcctcccgcctcagcctcctgagtagctgggattacaggtgtgcaccaccatgcccgactcatcttctgtgttttttgtagagatggggttttgccatgtttcccaggctggtcttgaactcctgagctcaagtgatctgcctgccttgcctcccaaagtgcttggattacagatgtgagccaccactcctggtcttgcctggcttcttaattaaacatcagttgtgagattgatccatattcttttgtctgtcgtcaaagatagttcatggtctttgctgtgttggaattcatctttaaacctccttttccctcaccccttcttttatctcatgaccaaatcctgtcaatgtcatcttcaaatctatctaaagtctcactccttccactggcagtacttcctgcttgaaggctgctttgtcttttgatccatgtcctcacttccattcctgtttccctctcctcctgtctacacatgcagctggcgggacagttacaaaaaagcagagtataccaggttattcacatacttgaaacatgtcatgagttcccagtgcatttaggatagttccctcggcctgcacgtggtctgtgaagccctgtgtgaactggcttgtgcctgacaccgtcccccgccctctctgggcacctctgcagctccattttgttcttccagttcctcccaagagtcaagcttttccctgtcctcaacgttggtatatgtgattttttttctacttagtttcccactctcccttgacctggcaaattcctgctctgtcatttctcagagagaccacctccaatgttcttgtctacattaaatcttcctgttattttcactggcagtgattgccacacctaacaccaacatttattgcatttaccaacacaactgttagagtaactgtctaatgcttgtcttcccgctagactgtggacactgtggggccgggtctttttgtttgctgttgtatctgcagcatctagcacagtgtcatgtatgtaatggctgctcagaaaatgagcaaattaaagcagagtctcaggaactatgacaaagtttacctgaacatgtaaatgagatgtcaatgaaggggacttttcatttacaccttttcggatctgaagcttttcagctgaaaataggtagattgggtatcaggatttctgagcatcttgcagctcaaccaatcaaggcaggcaaacattcacttaataagctgctctgaccaaagctcattctttcattttaagaaataccgtccctgaattacaagcagcataaacaccatcccagagtgacactttgaatgaaacattagagctgactgtgtccatattaaccccataggcaacaacattcatccctgtcctctgttactgttcttctcctccactactgtagcaaatacacaatatataatgtagtaaataaatgtgcagcgaataaaacgacagataagaagctgacctaactctggattgccaatggctttttagaccacaagagggagctgtttaaactcttgttaacaaggaaacaattgagggagaagaaatttggcaatcctgaggttggccagatgggcacctatttatatgatattgactctggaattacatttatttttaagttacaaaagttttaattctttttatctgcaatgtaattagcattttaaatagtgatattaaaggcaatgagttgtttttgtcttaaaatctaattttgtctcatttaactagtttggaaaagtgtaaatatttaattaagggacaaggagatgaagactactttcatactaaatctatttcctaaatacttactaataaaccgcctcatgaacaaataagcttttctttaaaaaatactgtttctttcaatagtctatatggtcttaaatatttaaatatgtgtgcaaatcagattttttaaaaagatatacacaaactatgacttgagaactcctttcttaagaacactgcagtctaattatagacatatttacataccatgaacccagttatatgacagctacccttgccaaccctcctggtcaccctgagaatgaatgcagttaaattatctaaagggacctgacccaagggcagagtgtgtttttctacaaaggggccagtgagagggcacatcggtgggagtcaaatgaccaatcgtaataacagtagtgacattcatggagtgtttatacaggccaggcactgtgcttaaagcaccgtacatggactagatcattaattccttccaaagctgcaaggtagcttctattactgtttttattttagagatgaaaaaacagaagggttaaataacttatagaagatcacagagctattaagtggggagccaggatttgaatccccctgcagaggaaggctcactaaatgtgattctcctcaactggcaagtctgactgtgggttaaagcatcaggcctctgggtgaaatgcttcttttcctgcaatggaccaaatctgtacattgttatcttcattttgaacagtgggattctgccaagattctcttcttcccataaaatgttttgtcctaagaagggagagaaagcttttgtcgttgtacactgggctccatatccaggatgattgtcagtgaataggaaatgtgttaaagatgatggtttcctgctgattcacttctgtgacgtcaagacttatgggaatacagacaaacttatctgaatgacagacatcacttaatgtaaaaagggaagccagcaaaatgttctaagacagaggacttctaaaaaattccaacagtttaccatagtggtcctagaacctaagtgtgttttgagtaaatattcaaacatgtcctatgagcagaaacataaatgtcatcttcctggctcatggtgggactgtggcccatttgttataggggaattagggggttaagaatccccttgctaatgattatctattgccattctgcattttctccttaccctaccctcagtcctattcctaactgggatctttaagtacttagaaaaccctgctggcccagcgcagtggctcatgcttataatcccagcactttgggaggctaaggtggaaccaattgcttgagcccaggagttcaagatcagcctgggcaacacggcagcatcctgtctctacaaataattgtttttaaaaatagccaggcttggtggcacgcacctgcagtcccagctacttgggaggctgatgtgggattatcacttgagcccaagagttcaaggctacagtaagctatgatcacaccactgcactccagtccagtctgggcaacagagtgaaaccctgtctccaaaaaaaaaaaggaaaggaaaagaaaagaaaaaacattgttacattgctaatatttattattgtagtatttatgaacaaacaacatttctgaatataaaaataaatgagccaattctcatcctttaaccctttgtaatgtgtcctcaggtctgcactcaaatttgccttgtaagtcaggtacagaatttgagagtttttaagaagcactagaagtcatagtgccttagtattcctacattttatcttgctagcccttttaatttcagtggttgaccaagtacagcaccagggccagaatgtgacatgaatttgactttagaaatgtgtattaaaatatggcagcaggagtgagaaggctctctggaagtaggcataggcatgaatctcaggcattccttccctacagggttgccagtttacatacaggctgtctggaatggtggcccgtgcctgtagctactggggaggctgaggtgggagaattcacttgaacccgggaggcagaggttgcagtgagaggagatcgcaccactgcactccagcctgggtgatggagtgagaccctgtctcaaaaaaaaaaaaaaaaaagaaagtaaaaacaaatataggctgtccaacaaacttgaattttggataaacagacaattttgtcagcctaagtgttttccaaatgttacagtggagatacttgtatttaaaattatccattgtttatctgaaatgcaaatttaactggatgtcttgtatttgtatttgctgagtctgccagcccttctcctcccctcactgatcacatggagcttagtggttaagaggataggccctgcatctggaccactcggaagacttgctagctgtgtgaatttcagcaaattatttagcttctctgtgcttagttttctcatctataaatggggataataatagaaccaattcaccttctaggtctgttgtcaggattaaatgattgaatgcatccaaccacttagtaattgtctcagtcctttcaggctgctataacaaaataccacaaaatgagtaatttataaacagtagaagtttattttgcacagctctagaggctgcgaggtccaagaccaaggcacaagtagatttggtgtctggtcagggtctgtcccatcgatggcaccttcttgaggcattctcacatgagatgcctcatgtgctcccttcaacttctcttataacagcaccgacccattcatgaaagccaagtgttcatgactcaatcacttcctaacggcctcttaatactatcgcattgggtcttaggttctaacccatgaatttgggaggaacacatacattcaaattatagcagtaattgagtaaatactcaacaaatgttagctattattattattacttttagagatgttcctcatatctaaaatactcaaatttacagtattgtggcagctattttgagaaccaaatgagatagtgtactgacagcatttggcatagagtatgccttccttaaccaaaatagctacacttctatgaaggtttgtatgtcatcagaaccctttctttcatttactttaagggattgtagaagtctgaagatgcagcactttgctctgtaactactgaggatggatttttgaaaggtccccggagagaaagagaaacagaggatttagcatatagctttcttctcaacattctgattatggacatttgtggttgagcttataaatcttatacctttattgaaaaattctgagtcctgggagagtaagtgattggccaaggtcaagccactccgtggtatatcaaaaagtaggacctatttcttgggtgggtgaggcttgaaggcttgacgtatggagagaaaaaagcctcttgttgtccgtggccatttgaccggcttatgtgcctgtgccccaccagccctcactctctcaaactccaagaactctgacttcctcacaggggatggtaggaaaggggtgtggcactccctcttgggggcacgagtgtggcagccaggtaggcagctccccagaggctcgtttgggagttaatgaatcctccccagtggctcattcacccttagggaaggacttgagtgctagagagagtagttatttatgtatagccccagctatatcagaggaacagtcgaatataaattcaagatctaataatttttattatctattaacagctgagatattgaaggtccctgaacactggaatctgcagttcctgagagctgtgtgtgtgtaatattgatgagacttccatcctgtcatcaattttctaagttggaaatcattagaaaccggacaaaatgaaatagaatttttctttctgtcctattgtctactccaaagatttccctgtggggctatccaaatagagcatacctgtttgcctatttcaagcaaaggccagataagagaaaaagaaagcccagagcatactctttggactgagctttgtctagagaggaaaccaggcagggatgaagagcaagtccaaatatagactctacctgccccttagggatgtgagagtgcaccaaggttagaaccacaatatatcagaactggaatgtggcatagatagctgatacatctaatacaacctgtcagtttacagacaaggaagccaaagcccacaacagtctggggacttccatgaggccatatgtctggttagaggtggaactagaatgagaaccttgttcttttgtccccctattgttggtttaattaattaattaattaattaattttagagatagggtttctctgtgttgcccaggctggaatgcaatggtgctattgtgactcactgcagccttgaactcctgggttcaaatgaccctcccacctcagcctctcaagtggctgggacgacaggcatgcaccaccatgcccagctaatttttagttttttgtagagatggggcctcactctgttgcccaggccagtcctggacacctggcctcaagtgatactcctgccttggcctcccatagtgctaggattacagatgtgagccaccaagcctggccttactattggttttgtgagaggactgttgctatccttttacaagtgccaagctaaaagttgccaagatcttgaacctgacaaagaggaggagctggaggaagcatgcaccacccttgcggggctgagtgtaactttaggaaattgggaaatgattgggactgtacttcagatgctcaaatgtctgaagagtcggggtggttttgagtttcggtttatctcttctgtgaagtgtgtacatgtaggtgatggacctggtaggaggaggtggggacaaggagggaatcaatggacaccacccaagatgaaacaaagcctaggatgtgagtcctgcctgcacagtgtttgtgaaccagttggggaggtccagtcacatgcagaatcatgagatgatgatgactcactgtgttataggtaaccaattgctaagtggtgtttcagaatccaaagtgtaacccatctttctgatccttgggtgaaccagcttccgtgagtcactccagcaaggaaaactgttttacttcattaagacggcatgtgtggcctctagagagactggagtcttaactgtatagtgtttctatttaacagaagatgaaacaacagtagtttgcaattttttacaatttcaaaattttcattcagaaactgctgtcatatggttgttgtcccaggaatagatgatgaaatattttcctagtagcattatagtcacaactgctatattttctttttcagtcagttttcagatgtctggtctttcctctgccacgtcttccagggccagacatttatttgtaatatgcctctttagtgtcacattaataataattgaagatgctacgctgtctgctctgtgctcgcaaagatgagaaagacggggcatttcccagagggagcacaccatctactggggctggcggtggggaagaagtagagggaatgggagaaggaggtgatgagacaggatcatagatcctttacctcaaggcaaggtaccagtagtgccaaaggagagtatcccagcaagctatgtgtgtgaactggagatgaaatccagttaggggcagccttaaggaaagaaagggaggaattagaaaagactgcatatattcatagaaggtggcatttgaacaggtccttgaagactgagtcggcacaatgttgcaaatctgagaaggacatcagggaggaaggaatagcccagtttggttgaaagtaggttacttgagggagttggtagaggtaagattgaaaaaaatattctgagagaactttggttgagaaggagtttggtcttcagttgacaggcaatgggaaagccttgaaaatcgttgagcagaggctcaatatgcagtcaaataactaccactgtttttctgtgtaacatttttattggaaagaaacaaatggcaaacaagctagctgatgtggcgatcttatttaagtcaaggaaactgcattgtgacacagaactaactacatcttacctcttatacttgctacatgtttgtcactttatatataaatgtttttcatattaatagcctgagaggctgtgaagtactactgagagaatcctcaatagaagatgtatgcaacaacatggataaatctcagaagaatcgtgctaagtgaaagaaggcagattcaaacatttacatactgtgtgaattcatttatatgacattctaaaaagggcaaaaccatagagaagtaaaacagaacagtggttgccgggggttagggttgggggaaaagatctgacaactttcaagaggaaagaattctttggggttttagagttgttctgtatcctgtttattttggtggttacaagaagctatgcatgtgttatagttcatagagcttaacatcaacattcgtactatataggtaaatttaaaacacaaatatacaaggaaaagaaggttcaattatgtttagataatgttttttatgtccaattcttcaaaaactggtaatctcttgtagtatgtatggcaagtatgtacatagatagatttaactaactatatatatcaatgaataataaattatcttactatagctataaaagaaagcctactatgttttctcagatattcagggactttattagagatcccactgtccttgtggtattaagtagatatgacatttgtgaataatatattaattgtttttacagtgactactcttgaaatatttcatcttctaagatttccttacgcattcctcttccaatcttgtctgtgtttgaaatgtgcttaataaagttttttattataatcatattaaatgtaaacctcaaatcagactggatcttacagattttgatttagtgatgttcaaataaatgaagttagcttttgaagtatggttgtcaggtacacttttctctcagcagagaatctcggtgataggtgactgtgttttcaaagtacagctattgcaacacataatccaaatcaaagtctcaaaccacattgtcaatgtgctgaggatggaaagtaaagggctttgttgtttattatagcccaggataaaaagagggactgacctattatagattacaagttccaaaattatttcattccatgtttcctttgaagcttttttttctcttactctaacttattgtgtgtttttgactaaaatagtggttgatgcttcttttaaaataacacattgccttttgacttaaacctgtgtttaactctgtagaataataggttcctggggctgagtgtcgtgctcctcaactccaccacgtttatagtttacatgttaatagggatggtgctccctgccagagaaggggccccaaccaaatctaacttctctttagaggcaaagggctgcagccacaaaccacatgaagtccttttgtggcatgggatggaatgaaccgtttggatgtgcattggtgtttttagtttcattctcatggatggctgtcactgatgataaagggcaatatatgttcttagagttatttttaaattagtaaaatttggtagatgagatttcaacgtccttaaaacgttccaggacactgacttcatcagacataattggaacatctttacttgtcagctgtatttccattgcatagttcctcatttctgcctgattgccattggtcgaaaccctgtctgagccttcattatattcagactgcttctgttctctttcctccatatacacagttgcagaactgactaacaaggcagacacattaaaaactctctaattgattattattgttctcaggatagaatccaaaattctcaactggtctcaaaagtctggagaccttgccttgctcattctagcagctgcgtttcttactgatttcattccccaccttacttcttccttcccgagagccttggtacatgttccctccacctcgaatgctcttcctcctagactgctctttccttcccaatcttcagatgcctgtttgagcagccctccccagagatgacatcccagagccctgagtctgagtcaatgccccttggtatgaatacctcttatttctccttagcagcacctgtcaaaattgcaattgagtaattagttatgaaattatttgttggttgctttccctggtagaactggcccatcttcttgggaacatttctgtcttatcccctggtgtttctccagagctcagccgaatgcctttgctcatggtgtttgtgcaatgattattcattgaacaaataaatgaaagaccaaggcaaccatattgaatgagcaaagtggcaaaatgagaatcagcacaagttggttccattctgcacatgagttgtggccgactgccactgttactacttgggaccgtcattacagcggttaccactgttactacttgggaccgtcattacaagactgaacgaggccgggcgtggtggctcaggcctgtaatcccagcactttgggaggccgaggtgggcggatcacgaggtcaggagatcgagaccatcctggctaacacggtgaaaccccatctctactaaaaatacaaaaaattagccgggcgcggtggcgggcacctgtagtcccagctactcaaaaggctgaggcaggagaatggcgtgaacccgggaggcggagcctgcagtgagccgagatcgcgccactgcactccagcctgggcgacggcgagactccgtctcaaaaaaaaaaaaaaaagactgaacgaagggacaaacatagaaatgaacacctaagacaaaagtaactattttaaaggaagggtaacgtggggaagaagaagaagagagaacaagagagaagaagagaagaagaaaagggctccctgcttctagtgagcaaaggcagccaccctgagcttgtgcagcccttcatatttattagatagcaagagcagggaggaggagataacaattggtcagctgcttaattgattacaggttcatattattactaatggcttcagatgtacctaatcacaagaaacactgcacttggggtgtgactgccctcagcattccttctggatggcagacgcagtttgtcagtttggcaacatcctgctttcatgagaacagtttgctgtttactcacatagcctccagtggtatattgagtcgatgatggccctcactctctcggcctccaacaatcagtggttctcaaaccatactatgcacatgcatcacctgggaggctccattctcagaaacactgattttttacatttgaagcagtggccaggaagctgcatgtgtaatgagcatcttgggtgactttgatgcaagtgtttgaggaccattctttgagaaacactgctgtgaaatgatgatttcacacaaaaccagaccaaggttattttaacactgcattcatgcagactcttttggatatggtgatcaaattcaacatcaccgacttgaaaacagatttacaacttagagaaaattaaaaaaaataaacttcttataactgagtagtaattaaaatgtggaaatatttgaaaaaaactattcatgataaaattagttcaaatattttatctaaatagtaagtaagcttatgatgctgttcaaactagtaaacacacgaatgctggtaagcatatataaatcagttatgatgacaaaagactaattttcccaaattaatcctttattttgttttattatttttaaatgaaggaccaatatagataattaatatagagaaaatacacattcatataaaggcacattaaatcagccttagctacctcagttgatgttctcttagatttttactctatactatatatttgtttaatatgatatattgaacataatgttatgtgatataattgtaatataatgttgtcttgccttagatgaataaactccataagttccagggtagggtctagggcaatttctctggcctacaaaagtgttcaattaatatttattgaataggtatggactcatgtattttaactctcatgcaattctcctccacacccagaagttagaagaaaattagtaacaaacaaatattcacataccaaattaaccctttgtagaaaacccaaatagcagcccatttctgctgctataacaaaatacatcagactgagtaattaataaattaaaaagctttatttatccagaaagctgttctgaaggctactaagtccaagatcaaggcaaaggtggattcagtgtatggagaatcttactctctgcttcaagatggtgcctcttgctgcatcctcacatggcagaagagatgaagaagaagatgaagatgaagaagatgaagatgaagaagagatggcagaagaagattaagatggtgcctcttgctgcatcttcacatggcagaagaaatgaagaagaagatgaaaatgaagatgatgaagatgaagaggatgaagatgaagaagaagaagagatggcagaagaagatgaagatggtgcctcctgctgcatcctcacatggcagaagagatgaagaagaagatgaagatgaagaagagatgacagcagaagaggaacatggtgcctcttgctgcatcctcacatgacagaagagatgaagaagaagatgaaaatgaagaagatgatgaagatgaagaagatgatgaagaagaagaacagatggcagaagaagatgaagatggtgccttttgctgcatcctcacatggcagaagagatgaagaagatgaagatgaagatgaagaagaagaagaagagatggcagaagaagatgaagatggtgtctcttgctgcatcttcacatggcagaagagatgaagaagaagatgaagatgaagaagatgaagatgaggaagatgaagaagaagataatgaagatgaagaagagatggcagaagaagaggaagatggtgcctcttgctgcatcctcacgtggcagaagaaatgaaagtgcaaggcagctctctgaggtctctttggactttaatcttattcatgaaggactttaatttcattcatgaaggtggagccctcatggcctagtcacctcccaaaggccccactttttaatatcataccttgttgattaggtgaaaggcctctagtcacctcccaaaggcctcactttttaatatcataccttgatgattaggttccaatatatgaattttgcagggacacatacattcaaaccatagcaccgagacttccccttcctacctcaatagcgtgggcagcagagacatacacagttctccttggcagccaccagttcatgtctctgctgtcatttctggcacatcagtgtgtgttttaggcaggatgacagtggctttatacatttttcagtatgatcacctaatttcacattaggtgatggtgactcggaaccaatgtgaaaagaaaaaattcagacgcaaaagatgatggttttcactctttatttaagtatgttctacttgtgcccaaacctgatgctgattggattctctgtgcttttgctttaatgggataacggaaggggaagaataagaagaatatgactgagggaatgttctgctctaactggtctgttttttattacattttattttagaggtgccataaatgcattttcttggctctcatgtctttttaagaactttatatattgtaactgtctgggaaaattaccaccttatttaaattaagtatccttaaagagatcagcctttataatgatgaaagactcattttcccacatgaatcctttattttgttttattatttttaaatgaaggacaaatatggataatatagattttaatatagataaaatacacattcatataaaggtacattaaatcatcagctctagctatcccagttgatgtttccttagatttttactctatctgtatcatacatttgtacatttaacataatgttaactctattcatatattaatatatcatagctctccaagctacagtccatgtagcaattattgcttcagagattccatggaagctaccaggtttgacagttcttagtactaataatcctgttcttggactctgcatccaattcattctgtgtcgcctgctagttgtgggttgagttaaaaccagttggaagaacaaaaatggcattaaagatgtgtttaaattgtcattgtgaatatctttattttacttttgtgtttgaggcttcagattcttaaataacacagttgcttctaaaacattggctcttcttttcttttcttggacttccatatcaacgcccaagacagtacctttttttttttttttttttttataagatagtgaatttttttttttttcgagacagggtcttgctctgttacctaagctggagtgcactggtgtgatcatggctcactgcagcctcaacctcccaggctcaagtgattctcccacctcagcctcctgagtagctgggaatacatgcgcacaccaccacaccaggctaagtgaaaatattccttatattccattaagagtcttttcaataccatgatatcttttatttagttgcagacttgtcgtggaaatgaagatgtcactggtcatgatcaatgattatcctcagttaaaagtgttcaggtatcagtttatctatattgatcttttggttagtagctgttttcaatatttcagatagtgttaaaaatcactgacgagatgatctagcagggtgtggcattcgacaatttggaaagaataaattcaccatgtcctctgccacaaaacctgtcctgttgaattcccagggtcatggccaccccactggcatcctgtgagtctttcctgtttgctagagagatcaaaagctcaggtggtggtagtggtggtagtgcggaaataagcataattctcttacgctacaggaagtatgttcagcatacatatgaagctctcttactggccaaactaggtgtcctggggttggagcttatcacataagcccaggcgtctgagaatgaaagacctggggcttgaatgaagcaattttgccaacagggagctatccaaggtactggcctcttccatcagcacttgctgaccgggtagcgtgtagctgctctcctggcagtgacacgtgccattttgtcggaaaggagccagccctgattgcctgaaccaagttccatcctgcttgacctggtctgacctatgcctggcctagcctttcctgacctctatacctcacctaacctgtgcctgttgtggccgtgacattgtctgctgtgacaactgccccagttataacctagaccaaacttctccaacacgcagcctgtgggttgcatgcagcccaggatggctttgaatgtggcccaacacaaatttataaactttcttaaaacgttataagattttttgtgattttttttctcatcagctatcattagtatattagtgtttctgtattttatgtgtggcccaagacaattcttccaatgtgggcaggaaaggaggccaaaagattggacagccctgacctagactaatggttctgaaacttggctcagcatcagggttactgggagacattgttaaaatagcatgaatcagaatctctaggagtggggcctaggaatttggggaccgctatcctggattaatttcttggctgtcttaccatgtttcctggaagagttgactctaattcctcttgtttttcttttccactgaatggaatgtaaattgtagtatttaaatttttcagaatgaataaacaaatgatgatatatccatacaatggaacagtactcagcaatggaaaggagcaaactatcgatatgctctacacaatggagaaatctcaaataattatgctgactgaaagaagtcatacaaaaaactaaacatattgtatagttgaatgtatataacattctatgacatgcagagtaatccatagtgatataaactcagggatgggttggcaggtgggagcacaagaggactttgtatgggctgggtatgttcatttcctttatacttttttttttttttttttgagacggaatcttgctctgtcccccaggctggagtatagtggcatgatctcgactcagtgcaacctctggcctcctgggttcaagagattcttctgcctcagcctcaaagtagctgggattatagacatgcacccctatacctggctaatttttgtatttgtggtagagatggggtttcaccatgttggtcagactggtctcaaactcccaacctcaagcaatccacccgccttggcctcccaaagtgctgagattacagacgggagccacagtgcccagcccatttcctttattctaatcattattttatgggtgcacacacacatgaaattatatcctttaagcaatttcttgtttattgaatgtcagctataactcaataaagctgttaaaaataaataaataaaagtttcagggagatgattggataaaagtgtattaaaaatccttatgctattaaaaacattatggaggttcttcaaaaaattaaaaatagaattaccacatgatccagcaatcctattactggacctatttccaaaggaaataaaatcagtatgtcaaagagctatctgcatctcatgttcactgcagcattagtcacagtggccaagatttcttaggaaccaacccaagtgtccatcaacagatgactggtgatggctcacagggaagagagaatgagctcctctctgtatggtggctgcagtatgctggaggtgcctgtgacatgactaggccccttgctccttccccagcccaaggacagtaaaggcagtatctgtactgctgcagttgcaatgggagaggggctatggtttgtctctaggatttcttccccagaaaatgtaaagcctccaccgactgaagtgttcaggcagaggcagggtggttgtgctaggagcccagtttgagaggccctgcccagtgaggtataacagaagcagggacatgcggaaaacagtctggccacttttccatcaggcagccatgctgtgctggggatcgactaagtccttaattttttcactccctcccaagcctgaagggaacagaggaggagaaagctgcaaagcagcaaaggtagtggcttgcttgctactactgggagctccgtcccagggaagtgcagagtagctgttggcctgagagcccagatggagatgggatggctgaggtcccacattgggaggctctgcccagtgaggagtagtagggaaaggtacccacgtggaaaacagtgtggccacttttcctaaggcagcaaaacttgtgggcctgcctgctccctctaggagctctgtcccagggaagcaccttctacccttcaccaggcagggccctcagcctgggcccatagagcagcttcccactcccaagtgagcatttccactggtggtggctctgagtttctctgggatggatcttccagaggcaactgacagcccctctgccactaccactgcagtggttctgcccttgctgcccttatactaaggaaaaggacaaagagcctgagggctttacttataccatcagctgcagctgccctaaggaaagagggcagtctgtcttctctgtgagccttgttcctgctgtttgtctccaggcagagcctcctggcttaggcccacaaggcagccactggagtctgggccaattgcactgattggtcacggctctgcatttctctggattggagcttcaagagacaagtgaaaggccctctgccattgtgtcaaggtccctgacccgaagctgggtagggaacgtaaagcctgagctcaccccagggctgcaatgtgcagcccaggagtgccaagtctagatctgcagccagcactcaggtaggagaggagctcatactctcagagcacaaagagggagcagagctgcaaatgtgaggaaatacagaggagccatgtggctgagcacaagcctgcctatcagccatgacgcttaagcaccatttactggatcacagcccaattgcaatgccaaaaatactttgctaatatacccacgtgaaaccaaggacaagaattcaaataaagaccgtgaacaaagccttgggcctctgaaaacacccagaaacaaatgcaactgaccacacacaaattacaccacagctagaggaaaaccagcccacacagatgagaaagaaccagtgcaagaactctggcaactcaaaaaaccagagcgtctttttacctccaaatgacctcactagttccacagtaatggttcttaacaaggctgaaatggctgaaatgacagaaatagaattgagaatgtggatcagaatgaagatcatcaagattcaggagaaaactgaaacccaatccaaggaatctaaggaacaagagaaaatgatacaggatgtaaaagacaaaatggccattttaagaaagaagaaaactgatctgatagagctgaaaaacttacttcaagaatttcataatacagtcacaagtattaacagaataagtggtcaaactgaggaaaagaatctcagagcttaaagattagttttctgaaataattcagtcagacaaaaacaaagcaaaaccaataaagaatgaaaaaaaaacctcttagaaatatgggattatgtaaagagaccaaatctatgactcattgttgtccctgaaagagaaagacagaaagcaagcaacttggaaaacatttttgaggatataatccatgaaaatttcctcaactgtaatagcaaggccaacattcaaattcaggaaatgcagagaacccctatgagatactatacaggatgaccatccccaagacacatagtcatcacattcttcaaagtcagaatgaaagaaaacatgtccctctccctctccttctccctctccctctccctctccctcgtctccctctccctctccctctccccggtctccctctgatgccaccaaagttgtgaaagccgaggctggactgtactgccgccatctgggctcactgcaacctccctgcctgattctcctgcctcagcctgcagagtgcctgggattgcaggcgcacgccgccacacctgactggtttttgcattttttggtggagacggggtttcgccgtgttggcggggctggtctccagctcctgaccgcgagtgatctgcctgcctcggcctcccgaggtgccgggattgcagacggagtctcgctcactcagtgctcaatgttgcccaggctggagtgcagtggcgtgatctcggctcgctacaacctccacctgccagccgcctgccttggcctcccaaagtgccgagattgcagcctctgcccggccgccacccgtctgggaagtgaggagcgtctctgcctggctgcccaccatctgggatgtgaagagcccctctgactggccgcccagtctgggaaatgaggagtgcctcttcccggccgccatcgcctgtaggaagtgaggagcgtctctgcctggccgccctgtctgagaagtgaggagctcctccgcctggcagccgccccgtctgggaagtgaggagcctctccgcccggcagccgccccgtctgcgaagtgaggagcccctctgcctggcagccgccccgtccaggaggtggggggcagcccccgccccgccagctgccccatccgggagggaggtggggggccagcccccaccgggccagccgccccgtccaggagggaggtgggggggcgtctccgcctggccactgccccgtctgggaggtggggggcgcctctgcccggccgccccatctgggaagtgaggagaccctctgccgggccgccaccctgtctgggatgtgtacccaacagctcattgagaacgggccatgatgacgatggcggttttgtcgaatagaaaagggggaaatatggggaaaagaaagagagatcagattgttactgtgtctgtgtagaaagaagtagacatgggagactccgttttgttctgtactaagaaaaattcttctgccctgggatgctgttaatctataaccttacccccaaccccatgctctctgaaacatgtgctgtgtccactcagggttaaatggattaagggaggtgcaagatgtgctttgttaaacagatgcttgaaggcagcatgctcattaagagtcatcaccactccctaatctcaagtacccagggacacaaacactgcagaaggccgcagggtcctctgtctaggaaaaccagagacccttgttcacatgtttatctgctgaccttccctccactattgtcctatgaccctgccaaatccccctctgcgagaaacacccaagaatgatcaataaatactaaaaaaaaaaaaaaaaaaaaaaaaaaaaaagaaaagaaaagaaaacatgtcaaaggcagctggaagtaaggggcagatcaccttcaaagggaacctatcagactagtagcagatgtctcagtggaaactctacatgccagaagagattggggcccatgttcaacattcttaaagaaaagaaattccaaccaagaatttcatatctagccaaactaagtttcataagtgaagaagaaataagatctgtttcaaacaagcaaatgctaaggaaaaatttgttactaccagtcctgccttataagaggtccttaagagaatgcaaaatatgaaaagcaaagatcattaccagccatcacaaaaaaatactgaagtacatagaccattgacactatgaagcagccacacaatcaagtttgcgtaataaccagttaacaacatgatgataggatcaaacccacacatattaatattatccttgaatgtcaatgggctaaatgcccccaattaaaagggacagagtggcaagttggataaagaagcaagacccaattgtacactgtcttcaagagacctatctcatatgtaatgattcccataggctcaaagtaaagggatgaagaaaaatctaacaaggaaatggaaaacagaaaaaagcaggggttgctactctaatatcagaaaaaacacactttaaaccaacaacaattaaaaaagaaaaaggagggcattaaataatgggaaagggttcagttcaataagatgacctaactatcctaaatatatatgcacccaacacaggatcacccagattcataaagcaagctcttagagacccatgaaaaaacttagactcccacacaatcatagtgggagatttcaacaccccatctacagtattagacagatcatcaaggcagaaaactggcaaagaaatttggaacctgagcttgatacttcaccaaatgggcctaatagatatttacagaactctccaccccaaaacaacagaatatacattcttcttatctgcacatggcacatactctaaaattgaccacacaattggacataaaacaatcctcagaaaattaaaaaaaaaacccaacctgtcataccaaacacactctcagaacacagtgcaataaaactagaaatcaatactaagaaaagcactcaaaatcatatagttacatggaaattaaacaacctgctcctgaatgacttttgagtacataatgaagtaaagacagaaatcaagaaaccctttgaaactaattagaacaaagatataacataccagaatctctgggacacagctaaagtggtgttaagaggaaagtttatagcactagagacacacatcgaaaaaattataaagatctcaaattaacaacctaacaactcacctggaggaactaaagaaacaagagcaaaccaaccccagagctagcagaagacaagaaataaccaaaatcagagctgaactgaaggaaatagagatgtgaaaaatcatacaaaagatcaatgaatccaggagtttgttctttgaaaaccttaataagattgacagaccactagctagactaataaagaaaaaagagaatatccaaataaactctatcaaaaatgtcaaaggggacattaccactgaccccacagaaatacagataacccccagagactactacaaacacacaaactagaaaacctagaagaaatagataaatcttggaaacatacaacctcccaagattgaaccaggaagaaatacaatccctgaacagaccaaaaatgagttctgaaattgactctgtaataagaagtcttctaaccagaaaaatctcaggactagatagattcatagtcaaattctcccagatttataaagctggtgccactcctactgaagctatttttaaaaattgaggaggagagactcctccctaactcattctatgaggccagcatcattttgatacccaaacctggcagagacacaacaaaaaaagaaaacttcaggccaacattcttgatgaacacaggtgcaaaaatcctcagcaaaatactagcaaactgaatccagcagcacttaaaaaagggaatccaccaggatcaagtagggtttattcttgggatgcaagtttggttcaacatacacaaatcaataaatgtgatccatcatataagcagaactaaatacaaaaaccacagatgaccatctcaacagatatagaaaaggctttcagtaaaattcaaaacttcgtattaaaaactcccaacaaattaggcattgaaggaacatacctcaaaataataagagccatctatgaaaaaccccacagccaacataatactgagtaggcaaaagctggaagcattccctctgagagccagaacaaaacaaggatacccactctcacgactcctaatcaacctagtcctggaagtcctagtcagagcaatcaggcaagagacagaaaaaaaggcatccaaataggaagagaggaagtcaaactgtctttcttcacagatgatatgatgctatacctagaaaaccccatagtctctgcccaaaagctcctagataaacaacttcagcaaagttttaggatacaaaatcaacgtacaaaactcagtagtatttctatataccaacaatgttgaagctgacagccaaatcagaacacaatctcattcacaataaccacaaaaggaataaaatgcctaggaatacagctaaccagggaggtgaaagatctctacaatgagaattacaaaacactgctcaaataaatcagagatgacacaagcaaatgggaaaacatcccatggtcatggaaaggaagaatcaatattattaaaaatggccatactgcccaaagcaatgtacagattcaaggctattcctatcaaactaccaatgacattcttcacagaactagaaaaaaaaactattttaaaattcatatgaaactaaacaagagcccaaataaccaaagcaatcctaaagcaaaaagaatgaagccgaaggcatcacattacctgacttcaaactatattacaaggctacagtaaccaaaatagcatggcactggtagaaaaacagacacacagatcaatggaacagaatagacagcccagaaataaagccacacacatataaccatctgatcttcgacaaagttgacaaaaacaagcattgggaaaggactccttattcaataaatggtgctggaataactggctagccacatgcagaagactgaaattggaccccttccttataccatacacaaaaattaactcaagatgggggcagactaagttgatcttccagagtgactgtctcttccagaatgggccgcagagtgcaggcattgctgtgctccagctcctctgggcctgtgttgccacactccctactgctatgagcttcttcaaaagtttcccactgtctgggccagtggaggggctcctgtagcagcagccagacaccaaggctgtggtgaatgggaagggcctcagcactggtaccctttatattgctgagagccacctgtcttggttagatggctctggattaagattctcactggaatgccccaccatttgtttacatgcattgtccagggaccaaagtgactatctaggagagcatttgtatgttatggtgaaagccaaatttgaagaaggatcaaaagaatttgttgctgacgaagaagaggaaaatagtgataatgatgtggaactattactgaatttagatttgtgcctagtgataaatcaacattggaggcaacattcactgcaatgtgtgaatgccagtacttgcatccagatgctgaagatgaagattcagatgcttacgatggagaagaatatgatgtggaagcgcaagaacaaggacatggggacatccctacattttacacctgtgaggaaggatttatctcatctaacggcagagggccaaacatgttggagattagaaggaacgctttctcagtctgtaagctgccagtatcatatggttggggtcaggacagaagactcaataggagatgatgaagctgggatggaggtggataccacaccaacagttgctggacagtttgaggatgcagatgttgatcactgaaaatgatttatgcaggtttaagattggcctcctctgtggctttcagatataggtacatcttataaatcaggaacaaataggaaattccttgaggaagttggtaaatctaacaaaacattggagatcatggggccaattttttcttctctgtatactctctctcaagacagctcatggtttaaaaacccattaacatgcgaataattcccagactaatactttctggcctgaccacttcactgagttttagacatggatacccaattgcctacgtgacatgcccacttagataactagtgggcagttcaaacttaatatgtcctatacagaacctgtaatttcccctaccgaccccatttcagcagaaggtgccacaatccttcctgttactcaagcccccaacctagggacaatccttggtttctcttttttcctgattccccatagtcactccatcatcaagtgctattcagtctatattcaaaatatatctcatacctgtacatcatcagctcctgctcagattctttttattttttttttaacatttatttatttattttggtagagacagggcctcgctgtacttcccgggctggtcttgaactcctggcctcaactgatcctcccaattctgcctcccatgtgttggaattataagcatgagctactgtgcctggccaactcctgcttagtttcttgcagtaacttataaattgctttccttgctttcactcttgcccctaaaattcatcttctatatggcagagtgatctttttaaaagtgtaaatcagatcatggccctgcctcctctgctgaaaattctccaatgacttcccgtcacaagctcctcaccacggcctccaaggccttccattagctgtcctggcccacctctctgactttcacacttcctgttttctcatccctgtaccttgaagtatttgggcccttgttatttagattaatgtcaaatctaccctcgcagaaaaactatttaaaaacaatttttttagggacagggtctcactctgttgcccagactggagtgcggtggggagatcacagctcactgcagccttgaactcctgggctcaagtgatcctcctgcttcggcctcccaagtagctaggactacaggcacacaccattgcacctggctgatttttaagttttttgtagagactgagtcttcctatgttgccctaggctggtcttgaactcctggcctcgagtgatcccaccttgacttcccaaagtggtagaattacaggcctgagccatcgtgcctagctgacctctttttgttttcttcaaggtacttaccactaattaaagtgattgtgttcatgtatttgtttcctagttcagtgcctaacattcctcactgaattgtaagctccagagaataagttccttgtctattattcaactgtttatgcccattgcctagattagtgcctgactcatggtgggctctcattgaaactgttcaatgaatgaatgaatgatctgcccattgtatgcatgttctttgcatcagggcctggctttttatacaaatgagaacaatacatgataccatctgtaccttcaaggaaggagcagtttggtagagtggcagaggcaagagctctggagcttgacagacctaggtcctgagacatggctctgtgaaatgggtgaccttggacctccgagcctttctgaattcagttttctaatctataaaatggtaataattctatctacttctagactttttacagtaacttttttcctgtttttacctgctattgaatagagtaacttttatagaattcaagtccaatttatattagcagaagttgtatctgcagcttacaaacagtatatcatcacagcaaagaatacatgcctgtgtatatgttcctctctttagatgtgtgtgtctgtgtgtgtgtgtaagggtgtgtgtgtatgtgtgagtgggtgagactctgtgtgtgggagtggataaatatgtgtgtggggggagtgtgtgtctctctcatatactatattacatatagtatacataatatataatgttatatattacacattacatataatacattatattatagtacattaaaaattatatatacacatttgatatatatatataatatatatatgtagagagagagagacagtttctcagaagaatgattaattctccaattcatcaaggaataattttctagcatgaagcagagtccttaacagccttatttaattgatggtaattggtattaagagggtataatttatagaaccagcattgaaaaaatacctctgcttagagttctaacgctgggtgataagaaccatcaagcttgccattcaggaagtccttgaagtttgtgaatgacaaataggtcaaggagaaaattgttgagagaccccttcaatgtcttcttaagtctctcaaatgtcaatcaataaatggtatcctccaaatgaaaaccttttccacttggaagcctgtcgtccattacaatagctttctctctcttttctgccacaagagcaaatgaaatgtatttttccaacagcagctttcaggaaagccagttagtgaattttaagattagtttattctgctccagattttgaagttattttttgatatttgatctgtgggctgaatcacagaatccaactttaaagttagaagggatctggagatcatttagttcaaactcccttgtgcagcttttctgtagacatgaaaattgtgctgttaatttttaataccattttgagtctttgaatgagagaattaagcttttcataattatgtgccgtgaccaccagcagtataggctgtgagctcttggaggagcttatgaggagaaactccagagaagcatgagttcttcatgtccaatatctggcatggaacccagaataaaggcttgaaaaatgaatcattcctaatatagtagttagagaaattagacaagcttgcaaacatgtaatcgttcacaacaaaataaaaggataaagacaaggaaaatctaaaataaccagcagggtatggtggctcacgcctgtaatcccagcacttagagaggcttaggtgggaggattgtttgaggccatgagttcgagattagcctgggcaacataattagactcatctctacaaaaaataaaaaaaattagccaggtgtggtggcatgtgctggaggctgaggtgggaggatggcttgagcccaggagtttgaggctatagtgagctatggtccgattgtgccactgcacaccagcgtggatgacagagtgagaccctgtacctaaagataaaataacataattcaaaaatgatttttattaggtttaaacaattagtgagagccccccctcccaataagtatatgctttttcatagcacttcccattccccatactaacttactaatttaatgtttctgttggtgactcatgctgaattgtgcagtaggaacacagagtgctgaatttccttagataatccacagaacggaaaatcaattttatgacaaataagcattgactaaaaagagaaatcagagtgtaaataactatcatcatataactcattttatcttctaaagaactcagtttggaaaatatctttatatctctatattctatgcctttataaccctatgatatatctccatatcatgtgtaatacatttatacaccactgtattaggcagttcttgcattgttgtaaagaaatacctgtgactggctgggagcactggctcacacctgtaatcccagcactttggaaggccgaggcgggcagatcacctgaggtcaggagtttgagaccagcctggccaacaaggtgaaaccccgtctctactaaaaatgcaaaaattagccaggcatggtggcacacacctgtaatcccagctactcgggaggctgatgtgggggaattgcttgaacccgggaggcagaggctgcagtaagctgagattgtgctactgcactccagcctgggggacagagtaagactctgtctcaaacaaacaaacaaacaaacaaaaaaaccctgtgactgggtgatttataaagagaagaggtttaattggcttatgattctgcaggctgtacaggaagtgtggtgttggcatctgctcggcttctggggaggcctcaggaagcttacagtcatggcagaaggtgaaaggggagcagggatgtcacatgaccagagcaggcacgagagaaagagaaagaatatgtgtcaggggagggggttgtcacttttaaatgaccagatcttgtataaactcagagcaagagctcacttatcaccaaggcccaagccattcatgagggatccgcccccatgatacaaacacttcccaccagtctccacctccaatactggggattataattcatgagatttgggtcaagaaaaatatccaaactatatcaaccaccgtattagtggtattgaaactaatggtatagtggtttaattgcttgcatgaaggcacatcggcagctaattggccgagctgggactcaaaactaagtccgactccactatacttcactggttctgccatggcagagaacagaaagggatttgaagatgacttaatcatgtgacttcatggtactggtgaggacacggggaccagaagaaactgcaacttgcctaaaatcacacaactgcttagtggcagagctggagtcacagttagttgtcccttgaccatgaagcctcattttagaaattttgctatttttttccctcttctctgttcctaaaatttactttttaagactgctgttgaacaaaggaaattcatgtcttataagtactatttacataatcagtatcctggaagtgaagtaatagcttagggactatatcatcacaggtctcttgaatgtgtttaggttagactgtgataaggagtgcagaccggctgaaatagcactttgctctaaaggatattttgattaaatagagcagctttatttctggcctgaattaataggtgatagaaatatattagcagaaggtaatagtaggtgattaaaagatttaaatagtaaattcagttctttgtctttttttcactaattgcactgcttatgttaattttattttattttttatttttttattttatttatttattattattatactttaagttttagggtacatgtgcacaatgtgcaggttagttacatatgtatacatgtgccatgctggtgtgctgcacccactaactcatcatctagcattaggtatatctcccaatgccatccctcccccctccccccaccccacaacagtccccagagtgtgatgttccccttcctgtgtccatgtgttctcattgttcaattcccacctatgagtgagaatatgcggtgtttggttttttgttcttgcgacagtttactgagaattatgatttccagtttcatccatgtccctacaaaggacatgaactcatcattttttatggctgcatagtattccatggtgtatatgtgccacattttcttaatccagtctatcattgttggacatttgggttggttccaagtctttgctattgtgaataatgccacaataaacatatgtgtgcatgtgtctttatagcagcatgatttatagtcctttgggtatatacccagtaatgggatggctgggtcaaatggtatttctagttctagatccctgaggaatcaccacactgacttccacaatggttgacctagtttacagtcccaccaacactgtaaaaatattcctatttctccacatcctctccagcacctgttgtttcctgactttttaatgattgccattctaactggtgtgagatggtatctcactgtggttttgatttgcatttctctgatggccagtgatggtgagcattttttcatgtgttttttggctgcataaatgtcttcttttgagaagtgtctgttcatgtccttcacccactttttgatggggttgtttgttttgttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtccattttggcttttgttgccattgcttttggtgttttagacatgaagtccttgcccatgcctatgtcctgaatggtaatgcctaggttttcttctagggtttttatggtttacagttctttgaattctccctgtgatgaagcctctgcatcctatttcataatacttacttataaagaagatccataaaatgagtatatcctgtttaaaatacagatgccctatctataagtgattttgttgttctgacatctaatgccattggcaaaaattataaacttttaaattttttttagagagatgggggtctcgctcaagctagagtacagtggcatgatcatagatcattgtagccacggacttctgggctcaagtgatcttcccacctcagtctccagagtagctgagactacaagtgtgtgccaccatgcccagataattttaaaaacaatttttatagagacagatctgtctgtgttgcccaggctggtcttgaactctgggcctcaagcaatcctcctgcctcagcctgccaaagtactgggattacaagtgtatgtcagtaaacttacaattataaatttcatacctctgtggtcagtgaaagcagttttcaattaataacattttggctaatatttaccacctgttgtaagtgtggcttaacatgtttaagtgttaacaattgctaataatacttatagtttgttggtagtttacatttctgttgaaggcatagttctcttctgaagttaccttctacgtgaggaaactccgattattataaaactcctagcttctctccaccttctcatttgcttctctccaggaaggaagaaagaataaatccgtttggtgaactggacacctgtaacccggcttcttcctcaggggagagagtggcccacggagagcaaacattttcctcagcttttccacgtggtcaggatgagtctgaggtttgtgactggacgggtgtctcattctagggtttgctgcaggaataatccatgtccttcaaccgagccttcatcagtaccacatgggataatttggctctccatcagctgcctttttttgtcttgtttcccaattggttcaggcctcagtggggaggggaggcctcagttatcagaacacctcacagacccaaactgctctgagccactgggctgagtcttgaggcgttaataagaagcacagtttgtgagataagcatcacatggagattgaggtttgtggcttggagggtgcttttagctctggtgatcctgtacttggtgcaaaacgcattagatttttaccaaggtgggtcactgtgtccacaggcaaggggctgttttcataagagtggttgtgtttctctaggggcagaagtgcaggcaccagggtctcagctgaggctcagaccttccacgaatctgcagggatctgagagcagactgctgcaggtgtgagttttattctgagccggcaaggctgaagcaagtgcttgattatagggaagagtcttcccttatggtctttagctgtcagggagcagagtaatatttactgttttaaaactgcaatgcagctgatttttgcacaagctaaagagaactaagtgagattttttgcctttaaccaacagcatcagatctaggtaagcgctgtgggattcctgccccaatttctgtttttctgttctgttctggttttttttttctgccttgccagccaagaaacggacagactgatcttgagttcttatggcttgtttataaaaaaaaaaaaaaaacaaaaaacaggcacacaaaaatctactgtcagattccatttacgtgctgttcaaatcccaggcaaaaccaatttatggagatatcagaatatttggtatctttaaggagttatcaactgaatgggggttccagggagcatttagggttattggaaatgttctctgtcttgatttaggtattgtttgcccatgtatatatgcacatacaaattaattgaagtgtacttgaaagttgtacaccttattgtaaccttaaagtatttatccaggcatagatgagcatggatgacttctctgagccagcaatttagcggcatgctccccatctgcagtgcttgctctaatggcccccaattcccataggctactaggggaggggctgtgtcagattctataagacacactctactggtttcgagtttgcctttaaagatgtatttatttttatttgatgccttcctggtcccccttgatgttttggatgctcaccaggtgtaagtggtgtaagagacccacccccaccagatctagggtgatggctgctgtgagaaaaacttgaggctgtctgctcccactgccctacccccggcaaactcagaaggtgccaagagactaaagaatgactcagacaagtccagcttggtgagtagatgagtttattaggacatgcatacagggcactccttggcagcagcaggatggctcaagagttccacaccaggttccgtctctaaactgcttttttttttttttttttttttttgagatggagtttctctcttgttgcccaggctggagtgcaatggtgtcatctcggctcactgcaacctctgtctcctgggttcaagcaattctcctgcctcagcctcccaagtagctcggattagatatgtgccaccacacccagctaattttgtatttttagtagagatggggtttcaccatattggccaggctgttcgtgaactcctgacctcaggtgatccacctgccttggcctcccaaagtgctgggattacaggtgtgagccaccgcgcccggcctctaaactacttttaagttaatcttctggctctttggccactgtgtttgagcactgaggctgttttccttggtaggttctcagatactctctgagatgtttgagttttcagggacatcggctccttggctgggcaccatggccttggctcactggaataaacatttagggttcaggcagcagacacacacccttgagtagcctggtgagggaaccactatcaatggccctaacataatcttgagtgtttaccacacagctgggtgaatcaaaggttagttctttagatgtcccaaactctagtagatctagtcctctgaccaaccggatgtctgtcctgcacaaggtgtaacttatatgtgccatatttcaaactcctgcacacataccacaatcatctattcttctgtaaaggaccagatagtctacactttgtgctttgcgggtcgtatgatctctgtgtcaactagtcagctctgcatgaaagcagctatagacaatacataaacaaatgggtgtggctgtgctccaagaaagcttaatttacaaaacaggtggtcagccagatttagtctacaggctataatttgcctgatctaaaccatgtaatcattctgaaaaattgacagagacaggtttattccatctttttttgctttgtttttgccagtaggggaactgagtcttggtgagctgaatgagtttcccaggttatctctggatagtgaaggatttccaactaggactcggatgaaatgtactcatgctattgacatgtagttttaaggtctatgagaataagtgtcatgtctaatactgcttagcattcaacttgaagcacttaataagtattctctcaattgagcagttttgtataactttcagtcttaaaacatcttcctattcagcctccctccctctctccctttcttcctttttttttttttttttttttttttgagatggagtttcgcttttgtcacccaggctggagtgcaatggcacaatctcggctcactgcaaccgccgcctcctgggttcaagagattctcctgcctcagcctcccaagtagctgggattacaggcatgcatcaccacacctggctaatttttgtaaatatttagtagagacggggtttcaccatgttggccaggctagtctcaaactcctgaactcaggtgatccacctgcctcggcctcccaaagttctgggattacaggcaagagccaccacacctggccttccctccctccctccctccctccctcccttcctttctccctcccttcctcccttccttccttccttccttccttttccttccttccttccttccttccttccttccttccttccttccttccttctttccttccttccttccttccttcgtctcactctgtcatccaggctggagtgcagtggcgcaatcttggctcactgcaacctctgcctccagggttcaagtgattctcctgcctcagccttccaagtagctgggactacaggtgcatgccaccatgcctggctaatttttgtatttttggtagagatggggttttgacatgttgcccaggctggtctccaactcctaagctcaggcaatccatctgattgcctcccaaagtgctgggattacaggcgtgctaccgtgcctggctttcctccacacactttctattgtctgattatcatctcagaaggaagcctgaataggcttcgaaggtatttaaattttaaaagaggacagctaaagaaggcaacactattttcagcagagctaaatgctacacagatgaaggagataatttagaaaagcatctcagatcaaagcatatcagtatcctcacctcgtttattaagatgtgtgtgtgactgtagccatactaagtgacacgaaagaccttgttaatcaaatcactcacccatcctttttgtggccacagaggagtgcgtccaggctaaaggaataatacttattgctaaatactgtcctatcgaaggctgaaaatatacatttgcttcccctgagctctacttaagagtagtagtcattccactgtttatcaaaacaccatattgtacaccttagatatatatgataaaaaagacatagcacacatctgctctacatttataataaaggaacctacaggcaattttgttttgtattgttaccctcttgcctttactcagattttattatttaaaccagaatccacaagcgatgtctgccacatcatgctgactccagggactgcgtatgaacaatctgtagttacggcttcatttcttgaaatgcccttacctttcagtgtctgaaacgtaacacagatacttaggaagaaggatggagagtatgatgtttcgttctatgagttatctactcttcctttggtgcaaaaaatatttgaaggggaaattatttactactgcattactctcctattcaaaagagatgtggccgggcacagtggctcacacctgtaatcccagcactttgggaggccgaggcgggttgaccatttgaggtcaggggttcgagaccagcctggccaacatggtgaaaccccgcctctactaaaattacaaaaaaatttagccagttacggtggcaggtgcctgtcgttccagctacttgggaggctgaggcaggagaatcgcttaagcccaggaggcggagtttgcagtgagttgagattgcaccactgcactgcagtctgggcaacacagcgagactgtgtctcaaaaataaataaaataaaataacgccatttttttctcaatgcagtttggacatcacaggggtacttggggacctctatgggaaaatgagacatggggaacagtggtgaaaatccatttgctttcttcctggtttcacttggggcctcacagctttcccctagggccagtcctgcaagatacaagcatttcttacttgcatattctaagaatattttgctgaaaaaaaattcatttcttctctgttttcatccaaacaattccctatccaagagatcctcctcatgtaaaaatctgatcaggtcaatcagctcctttaaaattcttctggtattcctcactgtctagaggacaggtgtatgcttccccttagcttggaacacagtgcttttatttattttatttttttaaattttattatttttgggatggagtcttgttctatagcccagtctggagtacagtggcatgatctcagctcactgtaacctccttctcctgggttcaaacaattctcctgcctcagcctcccaagtagcagggattacaggtgcctaccaccatgtccagctaatttttgtatttttagtaaagacagagcttcaccatgttggtcaggctggtctcaaactcctgacctgaggtgatctgcctgccttggcttcccaaagagctgggattacaggcgtgagccactgtgcccagccacatggtccttttgtgacctggctctcctctactttgtaaatgttccatttccacatgcatcctggactccagtcattccaaacagactctgactctaggtgccaggctattcctggtctcaatgccttgcatagctgcaccttctccctagaatatttctctgatgttctccctaaagaagtgcccatgttagttcaagcatcactgtctttgggaaggctgtttgaccttctcagccagagactggcgttttctcaccccatgtaaggatggctaccagaagatacattttccctgggcctcagcctcccttactagaccttgcaccctaacaagttctattcatttttgtatccttagtgcccggcacagtgtagaatttaataacatgtgctagaaataatgggtaactattttataaagaagaaaacttcagatttctaacattctgttttataatattcatatcacaaacaggagtttttagagggaagaggccctcattcatctttgtatttattgtgctaacatagtgcctggtagtaacacttaataaatgtttggggaatgaataggggagtgagcaggtaaatggatgatgtggataaccatccagtgtgcgcccagggctcagcctccattcatcactgtctaccacagaaagtctcgaggtagctggaagcaaggccaaagactcagagctcctctctctttggatgaatggctaagagattacagagggagccacaggcattgctaaagaatctaaagtcagagctgacctggggttagcctagtagaaatgtacttattaagtccttagttcatttgtttatttaatacatatttattgggtcacagttcctaattggaaattcttgaggcctgatgtgttcagaattcagattttcttcagattttagagtggtaatgtagcacatagcatgtaaagctatactagggcagagacccctggtatactggggtgtagcttggggcctagggccacatcatgggaaaaagcacattaatatttctgcagaaaagtgtatttatatctgcactacattgtggaataaataaaaactataaataggcttatgacagttcaggttaagttttgccttcaaatgactgaagcacagatcaggtttttctgccaattgtgctgcagaaaactttctctttttcagaactttttgggttttggaattgtggatgaggaattatagaactgtaacaatgattctctgcaagaattcctcttttagaagaaatttgggaaaatatccaacaaatattaattctatcagtaattcccaaaatggtttgattgaaaaaaagtcatctcaaagggtattactaaaatctaaagataaatgaatttaaatatactttcattaaaaaaaaagaaccttgatattacatcattatttttaacacatggcaaagtagagctaataagtgggataaagggcttcttattctaaaacagctgttccttgcaatctttactatggggaaaaaaatggtgaagggcagtgcaagggggcggcaataagagaacagaaggaagtagctaaaattagcactgtaggttcgaggtcctgctaattaaatttatactgcaccagcaaatgcttcagaattgttactttttcctgttatttaacactggacattcctttatctgtgcaggatgcatttatttacagcccgcccctttccccccctccaaaaaaaaagtagattcagaaacgcctgccctgggtaaaggtggagaacagcactctcccattaaagtttaaacctcatggccactgtcaagatggtgtctagagttttaccagtaggtgaaatcctcgttagaagctgttaggaaaaatacatgaaaaatacataatgtttcccttagttgttctggttccttaacatctttaaactgatcatctctagtttccaagagttctggcttttgaggggaaattaagattctattaggttgatgcaaaattttctatattaattacttcatatggaattacttttacatcagcctcatagaatcaatttctatattaggttggtgcaaaagtagttctatattaagtaattaatatagaaaattaatttttatattaggttggcattacaatggcaaaaccacaattaattttgcaccaacctaatataggtgagctacttttgtgacgagttttatcagaccctgccaaggtgtcctggtacaagtttcccagggaagggcttgcaataacgtgtgcaaatctgtgtactcacagggcttgggattatgtgacaatctgaatggtgcagagctcataggtcccaggagtctcccattttccccctcctgtttccctgttcccgttgtttgctctgcccttgggtgccccaccctgccatgcctgccctagctggctcacttcattctgtgggcctcagcttccttctgctttgaatctccgcttcgttcaacattgggtcactaatacagagatcttcagggttggctgggagaataccttgtatctttttgtgagacaacattttcctccttgcatgaccctcatagaactgtcaacctctctccttgtttatgttcctgtggggttaaccctgactagaaaagtgcaggacattctgccatcacgtgtagagggaacatcggggaagagagatgcaaccctctttgtttaaatattcagacagataaagtgcaatatataattttcccctctcagggctcccactgtgtctatatttacttggtggtgccgagatgaattttaggagaaagaaaaatgtcacctgtgttcatgatgctgtggcaaagaggtgtgtgcagaaagagaacttttacaacttaagcattatcttcaaggaaaggatgaaggactttgcccttgtgtaaagggattttagggatcagagtaggtcaaagattgactttcacagggctggagatcttgacagaactaaagacactcatctctgtgtgactgtggcccctcattacaacatgtccctaaggagccccagtagaaagcctcatttcatgggaaactagctcgtgctcaccgagctcttttcatagaagacatgcgttattattgaacattcattaagctctgaacgctgtagctctcaggtcttttgcaagaagagactagaaaaaagccatgtgggagtgatgatagcagtgcaatggtcatttattgaacacatgcaaattccaggtactgagctaagtatcttacatggattccttcatgtcatcctcataacgactctgtaagatgagaactattaatatgtccatttgacagatggggccactgagccctaaaggaggtcagcggcttggccaaggccacgtgatagctcagtagtggctggctggtagtggggtcccatgtagacccctgtcatgcgtgtgctggaagagaggtctgacccacagcctttcacatgatcaggtacaagctgaagacagaagaaagagggcatcggtggtggcagctgtaagagaagaagactttggtcttttgacacatcgtgctaggaggacagcctcagtgttcttagtgtgtgaaagcaactgtctcataataaaaataggcagatcagtgataatcaagatttaaaataaccctaaagtgtggaaagaagtgaatggaaaagtgactctttctctaggcgttgtcagtccctgcaggctgagctacctgtttttgaaaaagaacagaaaaccaagtctagggtggggcctggagccagccacatacactctgacctcgttttctctcaatgtctgaacaagcctgggaacataaatacttgagcaagaaaaacaagtcaggccctgagtggaggacaggcagcagcaagtaaaggaaggggagcagaggtgagagctaaggccctcacaggaaggagacccagggtctccaaacccttctttctgatatatacagtgatccttttccatcttatgtaaagtgctatgatcctgaagactcagtcccctctttcagataagactgctgcccctaagctctttctgaatggaaactctgccctaaacaggggttgaggaacttctggggaaactgaggagactcagtagaactgattctttgaagacagctggtctatctgtgctggagactcttctatggccagaggttgaaagaaggctctgcatggtggggaggaaatcaagttattgtcctaattctgctaaggaaagaacagcacaagaaaaccagtcccttggtttccatttttcccgagttttatgcgtttcacacatgcagtgtattcaagcatttcttctacaatttttttaatttgagactgaaatcctcttttgagcaggagtcaatatgtagctgataggcaatttacctgttgtatatttcctatcaggaagtcaacatcatttagtgacagacagtagagccatcactagccaacattacagttgcttgtgacagagttgaaagtgcataaactttggcctcagtagccttgggcttgaaccctggttctatttactacttaacttgtctttagtcagctttccaaatctctcagaggctcactttcctcacttgttaagtggacataaaatctaccttaagcaattgtgataaggatgaaatgagataaatagaagtgccaacatattcaataaaaactaggtatccttatctacgtgtagatctctgacacaagcagtatttatataaggattggaagcttgaagctagagctggcaaaaggaaaaatgtgttatgtatatttgaaaaatcatttatatttgatggagaatgcattgtacatcattcttcaagctgatttaccttgctaattacctatcactctggctaatattggaattagcttgtcattctcagcaatctctgatggcccgtttggtaggcgtgagagcccagaagctttctgagtcatttgggaataaatgagttgagggacttcagctacagtgagaatgacctcctttcccctcaaattgattatctgtaaaagagaaatcctttggaaacctttttccttaagtgttcattgcttacttttagtctttctcccacttctcatgcactctgtcatcttagcagcaccaaaataagttttttccccgactgctcacaaattgcgaagatatgagtgtgtcccctaatgttatatagcatattgcatctctgccatagacaccagaagtttcagctttctcaatttcaccttatcttttccataacatccgagagaaaaatgaaaccgtggcagagtgttttcattgatcaagcaggcttttaatgtcttgccttttgcttcttggcagtgtgacctctgatctcagctatatggccctcagtcttcagatcatccttatcctaaccaaactaacatatcttcatgctttagatattgaaagacacattgttttctttaattggaaaaaatactagttacataatgccctttaatcttagtaatcagcaagcatacaaataaaacctggaacattgttttgacaaaccattgcttgctttctgccttgtcatactgggtttataaactctgtaccatacacttgagacaccctgaaaatcacagtaattaccatagaacaagcttccccccatcactggattgtgaagcaggtgcactccacatatattggttataactttgtagcctatgttgaacaagtcatttactttgacaaaagtcaaagttgtatctgttataccctcttagcaagccaacaaatgccttgcgtggatgtgagtggagagttaccaccactatatgtgataacatagcttaagatgaggggagctgaggggagctgtgctgccatattttgtaaccagatactggaatcctttctcagccattgtccttagcagagctgtgtggagaaaatcttaaggccttccatcaactgattcaccgatttaggattcttttcttgatatctttaaattttattaaaatgattaatctatattatattaaatatgtattaattgaaaacattatttaaaataaatatattacctattttcaaaataaatactatttaaatatatctaaattatttaaataggtattaataaaaactattttcaataaatattattgtaaattaaaatcgggagtgaggggcctgaaaaaatgtatcccgcttctcagaccaactttggaaacaatagggaaatatagcaaaagagtaaggcaaatgggagttccaaatatcaactgatactggggaatgtagcctatgtccatgaaaagtgggcttgatggaatactgaaccccatgatgatcagaccaaaccacccagtccggagcctaaccctgtaaaatttcccacaaagaggaacagaacacaaggcaagctctctgaagtcaggctggagctgggagtgtggagaggtgggccgtgccagggctgtgcctcactggctgatccttccacaccagcagaaggggccaggagtgtttcccctagggagctccctctgctctccacttacaggaaagtctcagaactggagaaaaattcacctccatccctcctcagtggttaactcttttaggtaagatttagattcatggcagttaaattgtcaccttttgaacttctacattttcccagttaaaatattcctatagtgttggaatacagaatgcatattgtgaaagagaatagaatctcaggaccccaaactcactatgccaaatggaaagttaagcttaggaactgagtcacacacactgccttccttttgttcccaaacagataactgtgatttcacaaccctgtgtcacagcctcatccataaaagccaggttcccacaatgtgggaaggccacatatctcctcagatggcctccctcacaaactgcccacaaggaaattccttgtgagcccctcaatctttcaggagatatatcccccttataaactagccctcaaaccaagttctattggatctcggttcaatagcacctgacgatgtcaattaccaacttatcttcacaggtataggacaagaccagaaatcatccctccacccaacctgaaatgaatgcacatgtttactttttcttgtgtaaaaggtagatttactgagcagaagacaaaatacaattgactttttcttctaccctctctttccacatgtaaaatgtagatttatcgaggctaaccagagcctcccaagagtttgcctcactgcctacccttcctctctttttcccctcctgcttactctttctcctttaaatgttgaagttccaaaaaccccctttggaaaaagcacaggtcacagaggttcctgtgacttgtgtttctcccaggtgctccctcaaactttggctaaataaacctctattgtgtgtctcagtcactgatatggttgggatctgtgtccccaccaaatctcatgttcaattgtaatccccacagttgcaggaggcctggtgggaggtaattggatcataggggtggattcttcatgaatggttaagccccatacctgtggtgctgttcctgtgagatcttgttgtttaaaagtgtttagcacctccccagcccctcttcctcctgctctgaccatgtgaagtgcctcactccccctttgccttccaccttgattggaaatttcctgaggactccccagaagcagaagctgctatgcttcctgtatagcctgtagaaccatgagtgaattaaaactgttttctttataaattaccccgtctcaggtatttctctacagtagtgcaagaatggactgaaacagtcacttcttggttaacaatatgatgtaggaagacagtaccactatatttctactatcttacagaatgcttttgaattctgatgatgctctatataatgcttctaagggaagaatggagttagtattcctgcctacaggtagagaagaaaactgaggggcttatgtgagaacttgaagacccctgagaacacatgtccacagtgcttgagaagcagtgcatttagccctaaatgttgccacttgatgaccacctagcaacacaaatgggactgtgaatgcacacacaaccctgaaaaatctcatggattgcttgactataatgcacttatcctaacgatccagcctatgcttatacgaaaattttaaagttatcataaacatgaaaatacagagttagaaacattcttttggaaccttctttctcctgaaaatatcaatgcagaaactcaggttgagaagcacagaggcagcacacatagaattaggagatgaagccatcagaatgtgtctccctggttggtggctccagggctcaacagccgctttcaaggctaaggtacaaataaaggaattccactcctcacggtgcacctggccacctgccaggttgcaagctttgttctgggttctctccagaccttgctgtctcatagctgtcctgtcagttcaacattttaaccatactcctaccagcctgatggggggagactgtgaaaggaagctgagtgtttccctgagacctgagggactcagtaatgagaaggcggcaggggaaacagcttgatggaacaagcagagtttggagttaatctgggttcgaatttgggctccagcttctaattatgggacatctacaaataatttaacctctctgtaaaaggaaaataaaaagactctcttctaatctttttcttttttaagatgaaaaataatattgtaaagtgcctgacataggagaccaccaataggtagtggcaatgtgctttgtaggtatcgtatcaggggacacaatggtacacagctggtgccatttattcttttagaagaaatatcacgtgatgttcatctgaccctattttcagactgcctgaatttaaatcctagttctaccacttactagctatgacactgtgcaagtaacctttctgagtgccagttttctcactcaccttatacttttgttgtaaagatcaagtaatatgtggtaagcctttagcctgagtcttgatgcatagtaagtgctcaataaatgtgacttatactgttatttaagttgtttggttttaggcctgcagctacctgtatgaatacacagactagtgcctcttgaacttcagagctcatacaaatcacctggtgagcttgttaaaatgtacatcctgattcagtacatgtacagtggggctggaaattctgcatttctgttacacttcttgctggtccagcgaccacatgtggaatagcaaagtcatagaagcagactattcttagttttatcttctttggttaaaatgtttttgtttttgtttttttgagatagggtctccttctatcacccaggttggagtgcaatggcatgatcaccgtgcactgtagcattgaactcccgggctcaagcgatcctcctgcctcagcctactgagtagctaggactacaggtgtgcaccatcattagttgctatttttaaattatttgtagagatgaggtcttactatgttgcccaggctggtcttgaactcctgggctcaagcaatccttctgccttggcctcccaaaatgttgggattataggcatgagccactgtgcctgacctgaaataaaaaatttttagtagaatcagctgcctctgtctaatgcttctttctacccgaactacaaatgacccttgaacaaattgggtttgaacttcaagggtccaattaatgcacagatgaaaatagagtgaggttctgcagggctgacttcagaacttgagtatgtatgaattttgtcatacatggggatgggatggggggtcctggcaccagtctcccaaggataccaagggatgactgtactttatgtggttaattaatattttactgggtaataaaaggctctgggaagggttggttatcaggcctgcgcctaacattggcagggttcaaggcaagatttcaaatggaggcccatatgttgtatgtctaaatatgtaaaagttataaatcaaattgacaaatttaaataaaatatgtgctattcccaacaagcacatggaaagatgctcagcatcacaaatcattaagataatgcaaatcaaagccacataaaatatcacttcatacccattaggacggctactaacaaaaaagaaaacaaacaaaaaagcagaaaatagcaagtgctgggaaggatgtggagaaactggaacccttgtgcattgttggtgagcatgtaaaatggtgtgctgctataaaattaaaatagaattaccatattatccaataatctacttctgtaccccaaagaactgaaagcagagtctttaaatgatatttgtctattcatgttccttaacagcattattcacaatagccaaaaggtgaaaactacccaaatgtctgtggatagatgaatggataaacaaaatgtgatttacaacagaatattattcagcctgaaaaaggaacgattctgtcgcatgcttcaatgtggatgaacttggcggtcttatgctaaatgaagaagtcagtcatggaaagacaaatactgtaggattccacttacatgcggtacctagagtagtctgatttatagagagaaagaaagtagtgtaaaccaaaaagtatctgagacaggtctcaatcaatttagaaagttgactgagcctcccgaggtcctgacaacatgtgcccaaggtggttggggcacgacttggttttatacattttagggagacatgagacatcaatcaatatatgtaagatgtacatgagttcagttgggaaaggtgggacaactcaaagcggggagggggcttccaggtcacagatagataagagacaacagttgcattcttttgagtttctgattagcctttcactgagtgcacaatttgctggaatagtcacttatgccttagtctggcacagtgaaacaacaaagcaaaggaagcatcaaatatgcatttgtctcacatgagcagagggatgacttggagttctgcccatcctttgtccacaaggtacatagctttttgagggaggtgtatagctttttaaatctttgtagctgtcttactgaggaatagactgggaggcaggtttgccttatgccagtggtccccaacctttttggcaccaggaaccagtttcatgggtgggaggagattggtttcaggatgaaactgttctacctcagatcatcaggcatgagattctcataaggagtgtgcaacctagatcccttgcatgtgcagttcaccataagcttcgtgatcctgtgagaatttaatgccttggctgatctgacaggaggtggagctcaggtggtaattaatattttacccacggctcacctccagtggtgccacccagttcctaacaggccatggactggtaccagtctgtggtttggggggctggggatccctgccctacacagttcccagcttgacttttccagttggcttagtgatttcggggtttcaagatttattttcctttcacagtagcatggtggttgccaggggctgggaggagggggaggtggggagttgtttagtgagtagagagttttagttttgtgagatgaaaagaattctacagactggttgcacaaccacgtgaatatagttaccatgactgaactgtacacttaaaaatgggtaagatggtaaatttcatattatgtgtcttttaccacagtttcaaaaagtgctatcttactgtttttacaaatatacatttgtaataacaaaatttaaaaatgcttgcagcctggcatggtggctcatacctgtaatcctagcactttgggaggctgagacaggaggattgtttgagctcaggagtttgaaaccagtctgggcaatgtagtaaggcctcatctttacttttaaaataattttaaaaatgcttgcacatttatacttttataggacttgaagccagcaaagtttcaaagatactggaattatgtgtggatattctcttgactggctatgtttagaagtctggatgaagaataaagacattcccaactgataaactattacctatctcacataacttatttatttcttctatcatttcagcaaaatcactgattattttgttttaatgaagacttttatataattcagttgacattgaaattagacaaactttctcaatcactttggttcttaggtagttttttttttttttatttgttcgtttgttttttgagacaaggtctttctctgtcactgagactggagtgcagtggtacgataatggctaactgcagtctcaaccccttggactcaagcaatcctcccacctcatcctcccaaatagcttggaccacagaagtgtaccatcatacccagctaatttttaatactttttatagagatgggtctcattatgttgcccaggctagtctagaactactggtctcaagcaatcctcctgcctcaggttcccaaagtatgggaatgatgggtgtgagccactgcgcccagcctcttgggtagtctttttcatttattttttactcaatttttcattatttaatttctattctcaggtggtctttattactacattaattttaaattcatttttcatcctttaatttttattcagtttagataaaccttgctgaaatgatagtaactaggatttgtaataaaactcttcaacagtaaacacttggatttggaaataaaccatgaattttacctttcttgttcagatattataatagggtcacatacaatacattatcattagcacaaaaaacattataaaacattttaaattcaacggttatgctgctatcatttgcactgtggttttcactgtctctcaaaccagtatgtagaaacacatagtaatatcaagaatctgtatcatccttcatgtgtgtttcatttatgtgtattctgtatatacaaatgtaagagtaatatacattttttgatacggcagatgtcccgtagcctctgtgtgcacctgacacacataccatattaattcatgtattcctctgatctcataatttggaacacaaagagaagaaaatggacacaatatttcgaagtccgcagatttatgtttatgcaaaaatgagagtggaagttcagagttacaggtcacactgtgccaacaggtgctgagagacagagatgtcaggcactctttttaaaaaattattatttaaaaaaattttagattcaaggggtacatgtgcttgtttgttacacggtatattgcatgctgtgggaactggatttctagtgtactcagtacccaaatagtgattactgtacctgataggtaatttttcaaccgtcatcagatgctgtttatttattcatttatttatttttgagacagagtctcgctctgtcgcccaggctggagtgcagtggtgtgatctcggctcactgcaacctctgccttccgggttcaagtgattctcctgcctcatcctcccgagtagcagggactacaggtgcatgccaccaagccaaactaattttctttttttccttttttttttttttttttcagtagagatgggatttcaccatgttggccaggctgatctccaactcctggactcaagtgatctgcccacctcggcctcctgagtgccgggattacaggcgtgggcaccacgcccagccaggtgctgtttaagacatctttaatgagtgccctgagcaggagctacggcaccacctcactgttgtttatatgttgatggcatgcagggcccctcttccccatttctaagagcaatactgttgggaattattattattattattttttcagatactttcaggggtcattgtggtcaatgaatacaatgagccaaactgaaagtgatatccattttttttttttttcacggactgcaactgctaaagaaagaggcaaaaagaaagtgctggctcccggtgttccatttccccccacggaacagcacggggtgagggtcaggtggcacacagcccagatgaggggagttgtatgactgactgcccatgagtcctcagtcaaaagcttcttgtggacccaggagggccaggagaggggagcgggggaagggccagcagtgggaaagtgctgattccaagtggaggaatgtgcctcagccaaagcctctggataagaaggtctcagtggaagctcctgggaagcaaggaggcctctgaacggaggcacctagaatgatgtcacagtgagcaccgctggcccagaggaggccggtgggaggggtgtgggatcctctgtcctcaactttgactccctccagaaaattgcacggcactggcagtgcaccgagtctgtgtgcagtgggcagctctctgccaggggccttgcccgtaaaaccttgtaccggcccatggtcaggctcgaaaggccacacgtagggctttggcctggaactggacaactcagttactaggtgcttcaccttatgtcagcctcacaacaattctacgaagtagatatgatctcccttttaacagatgaggaaatggaggctcagggtgcataacttgtccagtgtcacacagcgaatgaacggcaagaccaggacttgaattctgatctgtttcacagttaggctcacgcatcttcctccagagcatatcgtctggtatgaacttctgggagagtattaaattaatattgtccccctcatccaggagctcacactcttcttggtgaaacagggcatacaaataagttatacagaaaagagacttaggcagggcatgatggttcacttgtataatcccagcaatttgggggcctgagtcaggaggattgcttgaggccaggggtttgagaccagcctgggcaacatagggagatccagtctctataaaaaataaaaaaattaaaaaaaattagctgagcatggtggtgtgcacctgtactcccagctattcaagaggctgaggtgagagaattacttgagcccagaagattgaggctgcaatgagccatgatcgtgtcaccgcactccagccggggcaatggagagagactctgtcaaaaaaacagagcaaaacaaacacacaaaaaagagattccatttacttgcaaacaaaaatatcagtcaactggtctggactatatactgcatccagccagctatcccctgctgccatacaatgcggtttgtcctgtagagcagagatgtggcaagccaaatctggccatgctcatttgttcagacaccatggctgcttcctcgctactgtggcaaagctgagtaattgccatggagattgtatggtccataaagctgaaaatatttcctaactggccctttatagaagaagttatagaaattgctgcggcagtgcatcaaaagaacaaatagcagaaatgaacatgcaacacgtgagtatctagcagaacaaaccaactgctataatgaacatgtccttagcctagccctttacaggaaggataagtgccttagttcttacaaaagatatcttttttccattacatgttctcaaaattataaataaatacctattttaagactctgcatatgtaggttttgaactggtttgttgattgattgattcatttcttgccattttaagcagtgacttttgttgaagagttaaaagctaaaaacaaattttaaaaaccttcagcatgcttctctcacaatatgtgtcattttgatgaagttatcagctagacacaagatgaatcagactattaatccaaactgctggagctcacatctgtgtatttcacatatggggaagtattttaagtatagattgcatcctcttggctctttataaacagggtccttagttacctgaaggctttataaccttcagcctggtgactggttctcaaatttcatgtaatgattagcctgagtggaaaaacaggaaaaggcagcagtgtaacggggaggagatggctttgggagcctggagttctaatcttggctgtgcagctccctggctcacccagacattaaatctctctctgtcctaatttcctataacctgagtttggagatagatgctcacctttgtgtgtgtaggagtagagcatccaaactcaattcctctcatgccttctgtctgaaaactgagtacatttctctgcatctgtgggatccttaacagaactaacccacattagctgttaatttcaacatgtgtttagagactgttctcagagctcattagcgtcttcctggttatggatgaggtattgtgggaggctgggtggactgaatcaggaaagaaggctatggtgtgttaagtagtcaaattcacaccttgtgagagtgtagtgttccctgtaatcctggttcgaggaaagaaatgggaaagaacccttcagtctgatctgcagaaattctaagctttcctttcccagaagtattcactctactcaggtgaccaaccagggtctggcttggacatcaaaatcactcaatacagcccttctcatcaacttctacaggacaagactggtcaatgcgaggctcactgccctcacctgcaggtatcatgctctttggagggtctggaaccagctccctggagtctgggaacttagctgaagtgttgtggtttccgttttttcttctgagggtcaagccaggctctggcctcatttggttggtccccgtggagtcgagcaatttctgaattctctcttataagacaaggggagaacttagcctattcttctcaggggattatttgtgagttgctggtttagtgttttccaattcttatatataatttatgttattaactgcttgttttatctgttgttgagagaggtgtgttaaatttctatgagactatggatcaatttctctttgtaattctgccaatttttgttttgaaaaatttgaagctacatcttagatgcatataggctcaaagttgttttatctttcttgtaaaactttcctctttatcattatgattttagccttccctttcctactctttttttttttttaatctgaaagtctatattgtttaacacttgcctggtatatctagtttccacccatttaggtttaatgtatttaattttgctggtgtaataaaaacactatggtgggtatggcagggtcctgagttttctgcaatgaaactccagtcattcttggatctttaagatgatcatgaaatttctgattgggaaactgagtctctttgcagagatcagagtgaaaaagttgtgccttagagatgacgttcaaggtagcttcagccaagctacccagagtggcagcaatcaataccgtccactagcagcagcctgttgggcaggaggacagagacaaccactacagaagggaaggaatcagatgcacaagctgagccacagcacccactttgctcattgtttccccagtagtcttgcctcaaagagatgatgtcttgctgagacgatggcattatgaatgacagtagctacttccttggagtgcccaatatctggatgaataagtcattattcacaagagccaaagataccttgaaactggctagttaccccttttatgtctctgaaaggatgccacctttaggaccttgtccaggaggaaatcagggaagcaaacgagagatttctttcaggaacttgaccttcatgttccttaatcagatggcccagcttggtgtccaagaacaattcctatctctatccttgccctctctgcttgtccttaccgccaaaataatctgcagtcttttttttttaatatagagatggggtctcactatgttgcccaggctgaccttgaactcctaaactcaagggatcctcctgcctcagcctcctaaagtgctgggattacaggtgcgagccaccaccccagcctcatctacaatctttagcctttggtgatttctgggagaagccatagtgtactttgaccatcaacttgttttcaacctttctgtattcatatgtttttgatgtgtctcctttgagatatagctgattgaaaaaaatcagtaaaaaaattcttactttgaactgctgaattaatttatccattcatttattaggagtactgatatattttgttttatttgtattacctaccttgtgcttccattttaccttcttcctggcttatttttgtttcttttttccttacttccctttattctttccttttttatggttttgaagttatacattctgtttctatttttatgctaatatttaaattttaaatacatatgattgacttaacaaagtccaaaataatatcccttctggcaaacttagtgctttaattctaccttctctatcccattttcagtgtgataaatgtgcagtagtttaggtcttcctcatttttagccctctcttcaaagttttttctttttttttttctttcaggaaatacttacctgccaggcacggtggctcatgcctataatcccagcattttgggaggccaaggcgggtggatcacttgaggtcaggagttcaaggccagcctgaccaacatggtgaaatcttgtctctactaaaaatacaaaaaattagccgggcgtggtggtgcatgcctgtaatcctagcttcttgggaggctgaggcaagataattgcctgaacccgggaggcggaggttgtagtaagccaagatcgtgccactgcactccagcctgggtgagagagtgagactctgtctcacaaaaaaagaaaagaaaagaaaaaaaatacttacctacatttaccttatgtttaccgactactatgctcatattttcttcagctcaatcctttctttttatttatttattttttattttttttgagacagggtctcactctgttgcccaggctggagtgcagtggtacaatcccggctcactgcaacctctgcctcccaggttcaagtgattcttctgcctcagcctcccaagtagcgggactacaggcatgagccaccatgccaggctaatttttgtatttttagtggagatggggtttcaccatgttggctaggctggtcttgaacctctgacctcaggtgatccaccagcctcagcctccccaaatgctgggattacaggcgtgagccaccgcacccagcccaattctttctttttactccagttttcttcagcctccaattctttctgtaaggatctgtaaatgataacttctttcaattttgtttgtctgaaaatttttattattgtatctaattcttgaatgataccttaactgggtctagaattttagcactttgaagatactgtgaaaattgcagttggaaactaattattgtaccattgctggtaatctgtcttttgctgtgtgtttacttttaaggttttctctttatttatattgagcttcagtttcactcccatttgtccaggtgtgggtttactcttatttatcctgttccgtactcagagcactttaaatctgaggacttagattttttattcaattctgagtacatttttcccttgaaactcaaatatacatatatgaatttctcattctatattccataattaaactcttctttaatattgtcttacatattcattgtgctgaattctagttaatttcttcaaagctgagccatttaatctattaatgtcagtgattatatttttacaagtcaagcactaaataaacgtcagctattattatccttccttgaataatttcaaacatactgattgcatagtctttctcaggttgtcctattaccttgcattcttggaggtattactcttcccattggtcacatctgctgtctctcccttaaggtggattgcttctttgtaaggtttgtcattttttcatgtctggcttattattattattttttagctaattttgttttttatttgggcttacagagtgatgtgggattttcttctaatggttccacttggattgtcactggtttgaggtaactttttgtattaatttctcaacagtacaatctagacctacccatggtgcaagccggcagtgttttacaggacactctttgaacttcgtttgcactttatgtacatgcatatacatgtagttatgttttacctaatttttgaaataatcataaggagataggctctgtgtttgttctattcaagagtttgcaggatttggagttttttattcttcatgtctgcctggtaaaatgtttgtatgcagccaactgttcaatatttggcttttcctcacaagacaccattccctaaactctcagaatttaagaaaaaaaactccctattttatttatcctgatgatggtaataaattggccaaggagccatcataaaaaaataaaatcagacaaaccgaccattataggctgattataataagaaagtctttcttgcatggggcatttagctaagccttacattcataaacactgctaagtcaattatttattttacatatatgtttgaacctttgaaataatgagattaatctaaaatgttaggtttgctgaaaatgcctggcattgtgattcatttgcattttcattttttgctgtcaacaattaggtggacattttaaaacttttcttagggaaagaaaaattcactacatgcaaagatttccatacatttccggggagttcagggacttcttggggcccaaccaaatacatcgagttaagattctttgacttatgtggtatttggcttagagttcatcatatttgagcacccttgttagggtatacgaggaggcccccaatgagtatcacccctcctttccatcccgtctctcaataatttaataaaattttaaaaatgtgcagtgtctaaaaaatgaattatgttcaaatatgaacagaattgaaaatgaaattcttttcaaatatcaaaattgaggtcaagttggaggatgtatcttaacggaaagcaaaatggctgtcctaactagatctcaggattagtctgattcaccagcgcagactctggtagtctggtccagggctgttgtctctgcgaattctgccagggtaatactaaggcggggaagagaagttcctgcaggctatgctccttctgaggagtgaagctatgatattgatcattggatttcccaagtttatccaagatcatggagtggatattgatcattgcatttcccaagtttaccaatcagttaagttcctccagttcccctagggtggagggagtagcggtggggagaggcttgggaaaaatccctccccatggaaaccaggagggagcaagacatttctcctcagtattgctgactaagtgtgtgtaagagggattcgactgcttaaaaatttgctatgaaaaattctcgacttgagtaatttacacccagattacctggctggaattgctgctgctggccgcgcagccgcctcatcataagaggcacttgcggaggttgatggtgaggggctcttccgggtaccactctgtctccctggcaacgtggctccacttccacagctcagaagaacacaagttttccagtccatcgtccgcgtgaggagaaattacatgcaatttacagaataccttgacgtgatactcttcatcctcacagggttacgtttttaaaggaatttacagtaggattcagggggctgatttaaaaaacacaaaaaggtaaagtctgtccatcttgagacattatcctttaagttgatgctaattgagatgaatccattgcttttaaaaacgtagcacttaaaaatccattcttattcactttcctaaaatcttaattttttttctgacgattgttggcttttacctctttaagtcacaaacctatgaccattttgcactgcttttcattgcccggatgctttaggtcattcataaactccagtcttttctcctctccgattctttcccacccttctaatatagtgactcatctcattatgttcctaaaagcctgacaaagatagtgtgtatcgattaagaatcctttaagacatgcttttctcataaatgcacctttgtgtagctgctctgggtctgaaattttgggctctcatttcactcgaactgggatgaacatttctggggacaaaacagctcaatggcgtttgtcaggaccccgtggttatacccaggaatgcagaacacagctttgagtcacacaatcaggacccccagtcatgcctcagtagtaaacaccgagttgtgagtatgaatacttgcttagaaggaaacctaaatggcttttcttggattccaagtccatcttttggtttcatttctgacagagctctaatttttctcagacttctagcctgctctcaaaagtaatacatgacattgttgcatggaaaaagtgttaatgtaaattttgagccagataatttaccctatatttttcagttaagtctttttaaattaaaaaacaaattttaactattgtaggtacataagaggtatatatatttatggggtacatgtgatgttttgacacaggcatgccgtgtgtaataatcaaatcagggtaattagggtatccatcacccaaagcatttatttctttgtcttaggaacattccgattctgctcttttagttattttaaaatatacaataaataattgttgactatcatcaccctgttgtgctatcaaatactagatctgattccttctatctatttttgtacctattgatcatccccactttgtccccattcccactacccttccctcagttaagtcttaaacaactatgttttgcagatgaggaaaccaaggctttaaaagaaagcatagaattctagatttgaacccagaaccatctaatctttgcctgctctacaagagttcttattttaatctttaataatattttgagattcggtctttgtttaacatcatcctcaggcaaggcaggttgtaataattatactacatagtcctcagtttttaatccaaataaactgtgtggaaaatattttccaccaaaggttttaaaatctgcttaacttgtcttgcaaagtcttatttactgactttcagaatctgggcaggaagtacaatttttcatttgttttgattttgcatatttatttgatttcttttattccagttggctagttactatctaaaaatgtagttatacataatcactggctaaaatattggcccacttcaccctacaatcctataacttaaaaattgtatttactaaacaaataatttatcatacattctcagtgtaaagattcagatactatgcaacacgtagattgaaatacaaaggtctccgttcatcaccattccattagaacttatactgatctccagggatagtcaccaaaagcagaaagatatttatcattccagccttttatacatgtgcttagggatttctgtacatgtacctacatatgtactggattcatttattcatttaatttaaaaggcagttagactatgcttgttgttttatacttgctttttctcctgtaatatttaaagatgtttgcatgtcagttcaagtagatctacctcattcttttcatggcaacacagtatttcattttctaataccaaaatttcctaaggtgtgttccatggtcaaaaaaaaattgggaaatacaaggttaaacacagttaactaggattccttactatagactatcagaggccccagtatggtaatggacattgtaaatctccaagatgatctatccagcatggaatgtgtagcaaacttcgtgtaccactttatttaatttgacgtcacagcttctccagggagacgctgcttctcatggatgatgtaaatgtgggagagcaggctaatacttaggatgcctgatctcagctggctgcactcaaggggccagtcagccggatacaatttagcaggaataaaaatgttgcacattggttttaaatatcaacagcacaagcatcgaataaggattaattatttttagaaaaagggaagtcttcacaattttatatgaatgtgagttcgatacaagctattaagctgatttgactacttaagctaatgaaaatttcaggtgcataattggaattattgtgtccagatcaacggaggaaattatttcactgtactcatgctgatccagctttagtccttcagctactcacagggaaagctctacctcttagcaccagggccaataacatgctcttgccattaaccctgactcaaccttggaagagggaggaaggcggcaggaagagaacgtaggagcctggacataactttagaaaataacaataacactgcatgtgacatgttagagtttataaagggtttccccaaggatccatttactcctcttaattcaaggctgcagatactatttccctcattttgcaaaggaagaaaataagcctcagagaagttatcaagaccagagctaggccttgagcctaattgttttgttttgttttgttttgtttttgatgccaagtctaggttatttcaactgtattccatttgtttttctatgggtgtgtttttaagtatttcttctttccattgtctgaatctttgctgttccccgggatactccatctgaactgagctaatctggtttctgactgctcacctgctctatacatttctctttttgaacataaatgctgaaactattaatgatgagtgggtttgcatcattgcactactttcccaatatattcttccactcccacctgctctcagctctttgcttctccaacaggatctgcggctgcccattttctcagtgctgctttcagtaaacgtccccactgcttacataacagaaagccactcacttacttatctggaatggctgcttactcgtcagtatcctgctgagtaagggctggtcaacattaaatgttctggagtggtctttggtggtatccactcttaatcattcatggtataaataggaaatgtaaaactaaaaattatataataaaatatctaagtaatgaaaagcaatttttaaagcattctattgccaaggaagaaaacctgtttctcagtgaggcatagctattgtataatgattattaaaatgttgatacaatgcctagattgctgtttatgtatttttcattaggttaatggaaaacatgaaaatttctggttgataaatttgcatacaaaatgtaatttctgaaagtggattaaaacaattttttattgtcctggatcaaacattcttttatttttctattttttgagacagagtctcactctgtcacccaggctggagtgcaatggcatgatctcggctcactgcaacctctgcctcccgggttcaagcaattctcctgcctcagcctcccaagtagctagaattacaggcacctgccaccatgcccggctaattttttgtgtttttattagagacagggtttcaacatgttggccagcctggtctcaaactcctgacctcaggtgatccacctgccttggcctcccaaagtgctgggattacagttgtgagcccctgtgcccggtcaagcattttttttaaaagtcaaaagtgttgatgcatgttcaaaaacagatattcaattattaaaaaccattttatccaacgtatcacctgaaagtattaccatattgagcttttgtgtaaactttatggaactggggttcaaacttcagaaacacataggagattttttgagaaatgtttaactatattgaaaaaaggagagaactttggaagatcatgatatgaatgtcatttttttttaagaacagattgaaaactggcttctttcttctttcacaaactgtccatatagctatggtgcttgcgattgacattggcattattgatgtaccaaatcacctttaaaatacttacctaaacatgctggatgtggtggctcacacctgtaatcccaacactttgggaggccaaggcaggaagatggtttgtgcccagtaattcgaggctgcagtgacctatgatcagaccattgcactccagcccggttgacagagcaagtctcttgtaaaaaagtttacccaaatattttaggtgcctcagaaaatctctcagtcaatcaagtaatgtaaactaataattaagcagtaaatgttactacatgatgggtgctatgggggaaatcaagaagtttaagataatgccccaaaacacagggaacttctaatctagttgaagagctaagtccatgcctgacagcagaataggagctcattgcctaattattatttatttatttatttatttatttatttatttatttattttgaaacagagtcctcatcttgttacccaggtcggagtacagtggagcgatctcagctcactgcaacctccacctcccggattcaagcgattctcctgcctctgcctcctgagtagctggaactatagacgcccgccaccacgcccggctaatttttgtatttttagtagaggcaggattcgccatgtgggccggggtgatctcaaactcctgacctcaggtgatccacccaccttggcctcccaaagttctgggattataggcgtgagccactgcacccagccctaattattaagtgaaccaaagaatttctccccaccctctaatatctacccttgtgatgtagatattaaatgagaagagaaagtaactctgtgtaggaggtgagttttgagtgatgtggaaggatgaggtggatgtgacccacttaagaagagcctggacagcatcacaaggaggtgggatggccagaggaaaggatgagaaaaacattcactgagtattaatgatattccagaccttatgcgtatattgtctcatttaatcctcatagcaccctaggaagtgaaccgtattttgcccatttttcagaagaggaaactggggtgcagctccagattcgaaaacttgtgcttttttttttttttttttttttttgctacacattttctctgtgaaagccttaaaaggtgagctagctctccctaaatctgtcatacagattgaaagtcaacagtgccctcacttgatagatggtaagatagaagcataaggaatcatatgcattttcaaaatgaaatagccatttgaggttactatcagttcatcctgatggccaagcagcacaccttccttatctataaatctctttcatgtttaataaatgtccttgaatttggccctttgttaatgtgacttatgaggtgtttatttcttcaaggcaattatttacaaatttatgaattaacaatctggtcaatgtgtacctgcgcctaagcaattagacaaatgttgttcttggcctctgctgaaaaccctcacctccctatgactttgcaccttctctcttcctgataacagacagaagacatatttcactggtgctcaaatcagctctggcattaatggaggtgctgaatgactttaagtaattatttaggactgtaaatttttgtttagctcacatatgtaacccttaattgccaatactaattagagatggatggaaacttgaggcccaaagatgccacagaggcttacagaatatagacagacttcactgaaagatgggattctaaataatgtctcttctttatttccttatcttaaccacctttgaatcctttagtttcattcactaataacaagttgatcctgctctgggagccaatggagtttcatgggactttggtttatactctgttttaaatttctcttcttttaatggagtcactctcttcttcgagacttttagaaattcatcttctcattgttaccaggagcagcattttgcattagtccatgattgcactttctatctgaagaattcataaaggttcaaaatacattgttaaaaattatcagaatgctatggcatcaaaatactggttgtcaaagaattctttgaagtaattttaaaattttattgtttaaataaattttttaaaaaagaaaatagagacaggatctctctatgttgcccaggctggtctcgaactcctgggctcaggttatccttctgcctctggctcccaaagtgctgggattacaaggcatcagccaccacatccgacctagggtgatttttaaagaagcacactaatagagttaacttcattgcaacataaaagcaattccattgcagtttattactgttttaaaaagctgaacagaatagcaaaagtgtaaaaacaaatccttcaatcctttttacaatttggtaaacattccctataattgtttgtgccgatgacaaaaatgtatacataggagaggccatatattttattaacctacatatgcctgtcaagaatctatcatgagtatctttctgtagcaatacatgaggatctgttttatgcatttgaatactgcataatatttctgtttttcttttttaaaatttggttttacgactccaccagatcactggaataaatactgcatgatgtttcattgtacgtatacatcatgataattctattgatggaaagtttgatttttttccctaattttagcttcttaaaaaagggcaataataaatattattttacataacatatattttatctataccttttcacacttaactcttaaataaattaccagaaattagactgatgaatcaaagggtaggcacattaacatttttgatacatagtgttagtttgccctccagaaatacattgccaacttatattttaacaaacatgatgtgaaggtacctatttaccacccactttatagcacttgacatgaacacaccattttgtcaaactggcaaatattttgttttcatttgcatttctttgatagttgctgatgttaagcatattttcctttgtttaaagtccgtttgtatttcttccaagaatttatatcttttccccactgctttagctttttcttacttatttctaacctctcttcatatattatggaccttattctattgccatatatgttgcaaatatttcctcaacattgttgtttgtcaactttgttattgaaatatggtaatttttacatttaatttttaatacatctgatatttaccttgacgtaaataggagtttaacctactttgttcccccaacattttaataattttcctggcgccatttattgaataattcattgtgttagatcagttgcagtaatgacctcaatttgcttactcctccttgtaaccatgacctttggtagtgccctcccccatggattctatgcttggtattgacttgtttaggctgatgggacagtagcaaatatgatacaaaagagcacttgaaaagtgattatacattggggcttacctgttctctgctcttagaactctgccactatctaaacaagcccaggttagcctgacggatggtaagagacatgtggcccattcacccgtttctcccagacaatcatgagatgtgtgagtgagaccatttaaaactagtcagctccactggccaaccagctgactacagacacatgagcaggctcagccaagatcaaccaagtctggtcagatcccaaatccacctggcttactctagcccaattgccatgccacagaattatgaactaaataaatgtaaatggttcttatttcaattgactgaggttctgagtggtgtgtcacacaataaaagataactagtacatccagcttacctgtactgatttgaaagtcgtatttatcatacactaaattcccacttatacacgtgtctatttctgagttccttattttgtttctttgatctatttatttcttccccttctaacaccacacttaaaattactgtagctttatggcatgttttactatttggtaggttaattccaccaccccatagccatgacaatttttttttttagaagaaatttgtcaagttccccaaaatgtcttgttgggatttaatttcaaattgcattaagttttgtaatattttgcattttcagtacagaaattggataagtttctttatctgctcttatattcttcagcagcattttacatttttcttcaaaaaagttccacataaattcttgtttagtttattacctattttatcagtcagggtttaacctgaaaggcaaaaccaacaggaggtacatattgaaatatttgttgccaataattgtgtaacaatgatgggatttggggggctagagaggacagtctagatctgtcaggccatcgggaagggcagactgtaactcttggacatcagctgaagccactatccagagatgaaattccttcctcctggaagcctcagttctgcttttctttttttgttttttcttttttcttttttgagacagagtctctctctgttggccaggctggaatgcagtggcacgatcttggctcactgcaacctccgcctcctgggctcaagcaattctcctgcctcagcttcccgagtagctggaattacaggcgcctgccaccacacccagctaatttttgtattttcagtagagacggggttttaccatgttggccaagctggtctcgaactcctgacctcaggtgatccgcccacctcggcctcccaaagtgctgggattacaggcgtgagccaccgcacccggccccattctgcttttaaggctttcagtgaatcgaatgaggcccaccaaaattatcaaggataatcatcattacttaaagtcaatcaattatggatgttaatctacaaaataccttcagcgcaacacctggattagtgttagattcaatactgggcatattaatttagtcacgttgctacatcaaaaagaccataacatttgtattttgtgtttttgttctttcttctaaatttttccttatattttctgataacttattttccatagaaaaacaagtgattaaaaaatgttttttgtaactcacacctatgttcttttattgtatttaagagtggggcttttttgcttgttttcaaacaactataatattttatatatatttcataaatattttataaatattttgttgtctttctttggtcagagtttctggaaaaatggtgaagaatagagtaagacttctgcttctaggagtttcagatgagatcatttagatcaatcctctttctggtgacaaattaaaaaatctgtgttgggtaggaatggtagctcatgcctgtaatcccagcactttgggaggccgaggcgggaggatcacttaagctcagaagttcgagaccagcctgggcaacatagtgagacattgtctctatttaaaaataaaaattaaaataaatttaaaagaatttttttaaaaaccctcttcttaaaagcttcaaaaagctaagaagatgatgaagaatgagaggaagagagtgcagaatttgagcttggcacttgggttcactttgcccctggtgctgtttctttttttttgagacggagtctcactctgtcacccaggctggagtgcagtggccggatctcagctccctgcaagctccgcctcccgcattcacgccattctcgtgcctcagcctcccgagttgctgggactacaggcgtccgccaccaagcccagctaattttttgtatttttagtagagacggggtttcaccgtgttagccaggatggtctcgatctcctgacctcaggtaatccgcccaccttggcctcccaaagtgctgagattacagaggtgagcaactgcacccggcctggaagggggatttgaacttgaatcttaaaggctgtgtaataatagctcaatcgatgttttacatgcatattattacttaatctctgtaacaactttatgaggtagggactattattatctgcagttacacataagaaaattgaagcatagcaatatcaagtaacacgcccaagttcatataagtgggaggtgaagtatcagagattcaagtctagagcacgggagaattttccagaatgagaggtagaggtggaaagtgttataaaccgggaaacaaagggaagaaagatacaaaacggtcatggtgtggattaacatgacatcccattttggcataagggaataatctcaggaggcctgttactgcttaacaggcagatggaagatgacttgaagaattagatgaggcagtttggactcagtcatctccaaagtgagcagccattaagcacctttcacaaaagagcacatccagtaggtgctgcttccatctatgttctcccacttcccctagtgctaactgcatgaaattttcttcagctcaaccctgtcttcatttcacctctttatttctttattttggaagcaggatttgatctgacaactcctatatgaggagagtctctatctgcacagttcatttttgttactttccttttccgtaattcagataaataaaaatgcccatcaaaagtctccagtaggaggctgggcacagtggctcacacctgtaatcccagcacttttgggaggctgaggcaggtggatcacttgagcccaggagttcgagactagcctggccaacatggtgaaacccagtctctactaaaaatacaaaaattagccaggcatggtggtgtgtccctgtaatcccagctactcaggaggctgaggcaggagaatcgcttgaagccgggaggcagaggtcgcagtgagccgagattgatggcaccaccgcactccagcctgagcgacagagcaaagactctgtctcaaaaaaaaaaaaaggcttcccaatagggaaggctgcttgagtttaatcttttagtgtgtttgggggccgggtgcaaaaagtgagacgtctgagagaagaggaagagtagccaatattaagggataaaatagctggatgacctggagggatagagctgtcaaaatggaagaaaaattcatttatgtgctcaggaaagacagtagcttatgattttcagtgggccttaggaactgtgatctaaactgccatttagccacaaggatgcctttttatttattttttaaattgcaaattgcctattgctatgattcatagagtgatgtccttatacaatgatgaaaactaatggtttttcttcaaaaatcaacttcaaagtgctgctccttcatctctcctgtgtcaccatttcccctccaagccaatgtctacccatatatgcttttcatcccgaaaaatagtcaaatgcatcactaagatttgggtatctaataattccccccaactccgatgtatttgactagactccctgactactactttttttttttctaaattagaaagaaacgaacaaaacaacaaacaacaagtgtgagacagctggagagagaatgagttaaaacttcaaaactcgagtgtgcaggctgttcctgggtctggccctgtcattgtaattcctgtaggggttcctataacttctcctctgagtgaagtacaagagggaattctgaaagcattagacacaaactacttgatatttttccatgtggttttcaccacttcttagagtaggtatggtctcaaattttggattctttcttcaggctttttttttttaaataacttttgaaaccctgtttgtgatttctaaaaagagcagcaaatgtttcaaggaaaaaaggaaaaaaaaaaaggtacatgagagtccaatctaggagatttacagtgaggagctgatgagttctgtaaaagttgtgttcagctctgtttcacctgtgagttcctgtacttttttctttttgtaatcacaattattatcctgtagccacatgataggaaatgctgttatagatgaaacaaagacaggcagcatctgggccacagattagataataatgaaattctttgtggttgacaagagaaaaataatgggtaatacaaaactgtaatcatatttttcatgcattagctacctataaattgcataccctgaatataagctgttgctgtgaaactttaaatgtttaagatttaaaaaatgaacaaatataatcagtctattctgattatatatataatgattatgtgatgtatgaagtcatatgcatatgaattgagcctgcatgtctggagggccgctccgcacatgctaacattcctcttctaccctgaacctagtccttaaaaacccatgcaccgttcagagagaaggtgcatttagagtgagagcttgccttctccattccctggccagtgaataaaaacctgattgccttttccaattgaatgttctttctgtgcaatatatacaaagtggagaaagaattcggtttaccagtgacaacaggaaggctgtcagcagatgtggccctttgaacttctcagcctccagaactgtaagaaagaaactccttttctttataaatgaccttttctttataagtttcaggtattctgttataagcaacagaaaatggactaaatcagaaaattagtactgagaagtagggttgttgctatacaaatacctgaaaacgtgggagcagccttgggactttgtaatgggtgggtgccgaaagagtttggaggagcaggctagaaaaaactgtttaggtgtgaatggagcattagggggtgatcctggtgagggctcagaagagaagactagggaaagtctgcatcttcttagagattacttaagtggttgtgatcatgtaaccaaaatgcagattcagttgcttgccacgtgcagaatccaactaacaacagcgaggtctggtgtgaagaaagtgaatttttattcaaaaactagcttacaggaaggagtacaggctttctgcctgaagggcactgctttacttgtagggcagaaagcagggatttataaagggggacttggcatgaatggcatgcaggggagtgagtgagccagtggggttttggtgacttgcttcagtgccttctggactgggtagctgagcggtgccatcatgggcagaactaggctgtaaagtgcattgtcttggggtcctctccaggtaggagagagttttctacagggcatattttaggttgtaaattgagtgttgtctcccgagacaatcccctggttggagaggttcttggctctggagcttctaagcacatagagaagcttgccctgtagggagtgtctggtgaagggaaggtaaaaggttataattgcattggtaaggacctaagtaggaagtgggaaacaggggaagaagaggaaagagaaaagaaaaaagtaataaaaaaaatgtattatctttctcttagaaaaatagaggtacaggccgagcacggtggctcacgcctgtaatcccagcactttgggaggccaaggcaggcagatcatgaggtcaggagatcgagaccatcctggctaacacagtgaaaccccgtctctactaaaaatgcaaaaaattagctgggcgttgtggcaggcgcctgtggtcccagctgctcgggaggctgaggcaggaagatggcgtgaacctgggaggtggagcttgcagtgagctgagatggtgccactgcactccagcctgggcgaccgagcaagactccatctcaaaaaaaagaaaaaaaaaaaaaagaaagaaaaatagaggtactgttacaatcagaatgttggtcgaaatatggacagtaagaccattccaatgaagtctcagatggaaatgaggaacagagtattggaaactggagtaaagaccatccttgttataaagcagcaaagaacttggctgaactgtgtccatgcctgaggactttatgaaaggcagaacttaagagtgatgaactggaatatatggcagaagaaatatttcaacagcaaagcattcaggccgctgcatgaccacttttggctgtttatagtaagatgagagaagaaacagaggggaaaaattttggaaaattcacagcctggccatgtggtagagaatgaaagagcattttcaagagaggaaaccaaggatgtgaacaagtaaccaattaatgacagaattagaatgaatggaagaaagccagaggctctttgttatgacaatgggagaaaacccctgaaggcatttcagagatctttgaggctgcccctcccattacaggaccagaggtataggagggcagagtggttttggggataggctgctgcccaggatcacttcgggtctgtgttccctgcatttcaagacagtgctcctcagtgccccatccatggctcaagcagccccaggtgcatcttgatccacagctccaggaagtataagttgtaagccatggtggcatccatgtgctgttgtctatggggtttcagaatacaagagctatggggatatgactgtctccacctatgtttcaaagaacgacttgtactggaagcctaagcagaaacctgccacaggggtggagctgccacagagagcctctattaggtaaattcccagcagaaatgtagggttggagccaccacagagagccccagcaagggcaatgcctaatgaaaccatggaagcaggaccaccaaggagaccacctaactgtagggccaccagcatgcaaactagcctggcagacctgtgatgtggcttgcacccagcaaagccactggggcagggcttccggagaccttggggccaagccactactccaatgtccctaggatgcaggacactgagtctaaggaaattattctctaacttgaagacttactgttgttttccctgttgggttttggacttacttgggacctgctactcctttcattttgcctatttctttttgggggtggggatggagtctcctctgtcatgcaggctggagtgtagtggtgcaatctcagctcactgcaacctttgcctcctgggttccagcaattctcctgcctcagcctactgagtagctgggattacaggtgcccaccaccataccaccatgcctggctaatttttttttttgttgttgttgttgctttttttttttttttttttttgcatttttagtagaaatggggtttcaccatgtgagccatgggagcaggcccaccaaagagaccacctaactgtagggccaccagcatgcaaaccagcttgggagtgctgtgatgtgccttgcacccagcaaagccacaggggcagggcctcctgagatcttggggcccagccccttctccagtgtacctaggatgcaggacactgagtcaaagtgtctcgaactcttgacctcaggagatcacctctccttagcctcgcaaagtgctgggattataggcatgagccaccgtgcctggcccatttttgcctatttctgccttttggaatgggaatgtgtaccctatgcttatatatagataatatgttttgatttcacaggcttacagatgagacttggactttggactttagagttggtgctggactgagttaagactttggggctatggggatggaatgaatgtatttatatgtgagaaggatatgagttttgtggggccaggagtggaatgctatggtttgaatatttgtcccctccaaaactcacattgaaatttaacccccaatgtggcagtattgagaggtgggtctttaagaggtgattggatcatgagggctcacccctcaatctattcatggattaatggattagttgattaatgggttttcactggagggaaactggtggctttataagaagaagaagagaggctgaacaagcatgctagacactcagccccactgccatgtgatgccctgtgccccctcaggactctgcagagggtcccactagcaaggagcaagaaggttctccccagatgcagtcccttgaccctggatttctcagcccccagacctgtaataaataaattcattttctttataaattatccagttataggtattttcttttaagcaaaaaaaaaaaaaagactaaaatgggtggattataacacttaccaatcactatccctttaaaacaatgttttttcttgaagtctttactttgatattaatgtaatcacttcagcttttttctctttgcattagtttggtatattttttatctatgcccttacagtaatatatctatctcatttgatttagttatatcttataaacatataggtgaattttgttacatcttttttttttttttttttttttgagacagagtctcactctgtcgcccaggctggagtgcagtggtgcgatcttggctcactgcaacctctgcctcccgggttcaagtgattctccttcctcagcctcctgagtagctgggactacagtcacgtgccaccatgcctggccaattttttgtatttttagtagaggcgggatttcaccatgttagccaggatggtcttgatgtcctgaactcgtgatcctcccaccttggcctcccaaagtgctgtgattacaggcctgagccactatgcccagccaagaatacttccttaacaattattttaaacgttacaaatacattatcacttaacagtaaatcttacaggtttcacagctcactgctatttcgtctagactacatgtttcgatttcttgagatctttattctgattcatttgttatttcagcagactacttcctggaatagttttcttcataaagagtgttaagagagaggctttcttgtcctccagtgctgaagcgggtttctttgtcctcacagaagagtgagcctttacctcagaagctgtaaatgttgtcccaccatctctctcagcatttatgtagcaaacacccacttcagtgtcagctccagcatctcttctatgaaatgacctgtttattctgaaccttatagaagtttctatgcatcctttgaattaacatttttcatcagcataccacttggtatgtgttttcctctattagaatttccttcactgtgccaaccttgttcctgccttggaggtcttgcactagctcttccttcttttcagaatgatcttccctgatactgcaaggctgcctccttcccaccattagccctcacttcaaatccatcaagtcgttttatgaccaccatatctaaaacatctcctaatcattgtcatcatctatcacattcattatcctgttttattgtcttcaggagtgtttattatggtctgatattatcacatttatttatttgtgctgattgtcttcccttcacaactggaatgtaaactccatgaacgcctctgctgtatgattttctactctatctttggctccaataatagtgcctagctcataggagaagctgaatgaatgaaggagaaataccaggagctgcttttcctctttctaagattttccaaatattttccatgtgatcagtcctcctcttcctattcaatttgctaactatccaaccattcttctggtccacctcaaggcttttggttagaagtaaagtaacaccccaccccccaacccctgcacacttgcaagagggcaaatggatacacacagaatgaagttcaaggaactctagcatattggacagctgaattattcagctgacttaatgaagttcacaaagttcctggagtatctggtagaactcctgtcctctgtttgacattatttaaattactctccagttcttatttctgtttactgcctagtcacagccaaagagtatcgaatgctgcttttgttgtactttgtaaatatgattcaacagatatcaagattacaattgtaaactaatctgtttttgttagagatttggtttaatatgatttggtttggctgacctaatcaggcttggcaatggaagttactctcagaaatctaatgccaatagtaaggccactttcttcagatattatgcctggagcatatagtgaaggctagaaacctgggttccccacactgctgtttttgctttaccacaccataatcttgcttaaagaaacagagtcgaagttataagctgctataactaattttaacaatgaaaaagttttattctattagtacatgttaggagtgttataaatttactgaatgtaggcatagatgaatataaataaatactaaaaagagttcaaatgagtgattagttaggctttgcttatagctatgaaatcttcctgggatgaaaggggatcacactgaagaaatggaagaggaaggtgaaagtttggaaagactaggaaacacttgtgcttggatacatatatgcaatgatttgatattgagtgtctataaaattctcatttcctgttcatccactctataaaactcaatttgtagtagagattgctgagcaggaaatgcaatggctgctttgaagctagcagttatagtgctattcaccaaatcttaccagtgataagagacttctcagagttcctttttcttctggcgtgatgactagcaggggtcctctggtggctgctccataagcctgggtcctgcagcgagtatgatagagattagagttcccagctaagcaccagggatcatatattgatcacacattgtgtactagaaataaatctttcttgctttaagacacagagatttgggatagtttgttattgcagtataacctagcccacccaaaccaatatatagagcttaaacagcctactccaatgggaaactttatctaatctcttgcttcgaataccattcttttcttccttttttttgagacagagtctcactctgctgcccaggttggagtatagttgcatgatcttggctcattgtaacctccgcttcctgggttcaagcgattctcatacctcagcctcctgagtagctgggattataggcgtgtaccaccacgcccagctaatttttttgtatttttagtagagacgtggtttcactgtgttggccaggctggtcttgacctcctggctcaagtgatccgcccaacttggccttccaaagtgctgggattacaggcgtgagccgctgttcccagctgccatttctcattcttcctctctgacatctcagtctctttcttgtttcttatgatcctccaccagttttgggctttacttcagcattacatctttaaaaaaattttttttaaacttttgttttaggttcggggtacatgtacaggtttgttatataggtaaactcatgtcacaggagtttgttgtgcagattattttgccacccaggtagtaagcttattaaaaagtcaaaaaataacagatgctggtgaggttgcagagaaaaaggaacatttattcactgttggtgggagtgtaaattagttgaactattgtggaaagcagtgtggcaattcctcaaagagctaacagcattacgtcttgaatcttactgccttacccaactgataggcacaaataaaaacatgtatactttttaaaaaattatttattttcattttttcttcagataccgtgacttcaaaaacatgtataatttaaaaaataacttaaaaaatttccaagaatcccagcactttgggaggccgaggcgggcggatcacgaggtcaggagatcgagaccatcctggctaacacggtgaaaccccgtctctactaaaaatacaaaaaattagccgggcgaggtggcgggcgcctgtagtcccagctactcgggaggctgaggcaggagaatggcgtgaaccccagggggcggagcctgcagtgagccgagattgcgccactgcactccagcctgggcgacagcgagactccgtctcaaaaaaaaaaaaaaaaaaattccaagaagaaaaataaaagggtgaaaagatctggtgggaaagtatcagagaaaatgggacagaagaggctgggtatggtggctcacgcctgtaatcccagcactttgggaggccgaggctggcggatcacagggtcaggagattgagaccatcctggctaacacagcaaaaccctgtctctactaaaaatacaaaaaattagctgggcgtggtagcaggcacctgtagtcccagctgctcaggaggctgaggcaggagaatggcatgaacccaggaggcagagcttgcagtgagccgagattgcacaccactgcactccagcctgggagacagactgagactctgtctcaaaaaaaaaaaaaaaagaagaagggacagaagaataacattatgtaagatttccagcatatactctctcttcatttcccattcctttcatttcttcattcaggtaacaaaatatttagcatttgctatgagccagttttaaccatcaggacaaaatggcaaacaaaagtcatgaaaattacagtctagctgaaaagacaaaattaatcaaataattatacaaataaatgtaaaactataatagtgataagtgctatgaagaggagatgcacacattatgtatccgtatctattgtctgtccatctggaatgataaagcaaatgtaagacattcataattagaatatattgctatatagaaataatggtgtacagaaattcttggtactattcttgcaacttttctatatgtgtgaaattatttcaaaattaaaaaggctttttcaaagcactaactggtgtggtggtgtgtacacttattagacagaattacctggattggttatctctgtttagtacttgattcaaacttggccaaattatattgcctggcattgtaattcctctttcggtgctaatcactgtccctgcagaatcctgtggcccacacatggtaataaaatgaatgaaaaatccattgtaaatcacactttgtattaaaacatatgaacaaaactccctgcctttgttttttctattttaaaaagtgatacgtaattaatatgtaaaattaggaaagaatacaataagtctaatgaaaaatgaaaattacttataactcatcagtcagtgataatcactgttaacatgttggcaaatttccatcatatgtttttcatttagcagtgtgagttgtttgttgtgtgttgcaaattaccctgaaagttagctgtttaaatcaataaacattattttacacagtatctgaaggtcaagaatctgggagtgactcagctgagtggttctgaatcaaagtttcttatgaggttgtagttaagtcgtagctacgatagcagtcagttgagagctggggaattagtgtccaacttcattcatgtagctgttgataaagaggcttcaggccctcagcaggtaagcctcttcattgagctcacataatatgaaagctgccttctcccagaggaagtgatgagagaaagatagacagagagggagagaagacagaatgtgcagtcctttataacctagtcttgaaagtgacatatcatttctgctatattccatttgtcatacaggctaaacctgacacagtgtaggagatccctacacaagcatgtgaataccaggaagcagcagatgttgggggccatcttggaggctggcgatgagataacactctaccatgagtattttaccacattgtaaaaacatttcctacattatttcagtgattgcattatattgttataggccttcaaattcatgtacaaaggggtattataaagttatgaggctattttttcaacaaacacaccagaatttgtccattcctccaaatcagtgctgtctttcaaacagctcaccttgggaacctatgaacttattctagagatgtcaggctgttgtcacagacaagcctggggttcctttttgaaattaggactggactgttgcagcgtagtatttttaataaactcaaagatgatatgaggcagttatgttagcaagtagaattgctgtagtctgagggtgttccccaaaattcatatgttgaaacttgtctatgtcattgtctcatgcggtgcttaagtcatgagaatggagcattcacggatgggatcagggccattacaacagggcttgtgggagggggtttgcctctttccacctcttctgccatgtggtaacatggtgtgaatctccttttcctgtctcttctactatgtgaggacagagcaatgaggcaccatcttggatgcagaaaacaggccctcaccagacactaaacctcctgacgacttgatgttagacttcccagcctttagaactgtaagaaagaactttctgttatttataaatcaccattttgttacagcagcccaaaaatgctaagacaagaacatatgttggatttattcttgttctgctgctgctccatttgcaataccagaccagatgtattatttaaaaatgtattttgacacccaactaaagcttaacaaaatgatatttcttagtcaaattaatcatcacatgaatgaactatgggtgttcaactatgggtgaacattactgattcagagatttctgctctttgggctctgaatgggtcccccgcccccagccacctgcccagtgagtatcttgaagtgtttcttccctaagtgtaactctcaggagaagtactatattgatagaaacttacattctccagggtataatactgtatttatgtatttacatagccatcaattttgctggcaaaagaaaattgtggactgggaaagcaacatgaaggcagaatcaaggcttatttcactttgtttctcatggtgcctggcacacagtaggcacctaatacatgtttcttgaattaataacagtgaaattcttgtgttgtaaaaaaaaataatacttgaactgataatacttgtctggtagtctaaatcttaaaaagattcatactgatatttggtactggggtttccttttttcactttgacgttgtgacattgaagaatgacgttgtgacatttttcttaaagtcctgcggtaacattagttggactgaaattgacagcatgctcaaaaacatggacatggtttttatgttcaaactccccaagtaaacaacaacaacaaaaaatcaccaccaaaaacaagtacacaaattaatatcaggattttaaaactggaaccatcttctaactttccttggagttgcaataggtttagttgtgccatctctatactaaaagccattgcagttattggttttctctaagacatctagaaagatgtatgtgtgtgccatatatgtagtcatcagaactttttcaaacaactgctcggggacaggatgaggcagtgaggaaatgagcaaattgctaccattctcccagaaagttaatgttatattagtggctctattttggaggaggaaaacaatccagtttcaaagttagcataagcattatgctcatcactctctcacttccttacagagggcgcaggagagtctgtaatttcatgccaagtgctctaatgacgatgtggcatggctttttgctttacctggtttcttcctatactaaagggaaaaggaattaaaggcagttccaatgttgaaacattgagcccagaccattacaaataaaaacagaacaaatcctaatgaaaggaataaaattccctataggagctctgtaatgagagaagtcaccgggtgcccagagtagtctgagaagcatacatttaatgaggttctggtaaaaccgtggggacctagccattctctcaatgcaaatgagcggttcccatcagcattgtcctcatcctttggtgaactcctctcctttctctctttcttttttaaagcataacttcatgcttacagaacagtcaaaataataaaaagaaatggagtgccctttatccaaacctaccaaattgttagtatttctttctatttgcttgctttatcattctttctctctctctctttctctctctctccacacacacacacacacacacacacacacagactcacatttttatttttttagccatttgagaagttattttgtccctttaccgtaaaatactttcaggtgtatttcctttgaacagaaaagaatctgcttacataatcccaatacaattatcaaatcaggaaaattaacaatgaaactatcttttttctaatctatagctcttatttatttatttatttatttttgagacagagtcttgctctattgtccaggctagagtgcagtgatgatcacagctcactgcagtgatcaccactgcattccagcctgaagcccctcctgggctcaagtgatactcctacctcagcctcctgagtagctgggactacaggcacacctgcctaatttttttagttttttgtagagatgaggtttcaccatattgcccaggctggtcttgaactcctagactcaagcgatctgcccgccttggcctcccaaagtgctgggattacaggtgtgagccatggtgcctggcccttattcaaatttttcacttatctgactaatgtcctctggagaaaaagaaaaattacattttttttttttctgatccaggatccaatcgaggatagcctgttgcacttggtttttgggtctctttaatctcctttgatttgggacagttcctctgtcatacttcatctctcatgaccttgacaattttgaagaatattttgtagaacgttcctctgtttgggtttgtctgataagacgtaggttatgatttttgggaggaggatcatgaaagtgatgctgtgtcctccttcatcagcatgtcaggaggcacatgagtttggtctactccaatattggtgatgttagctctgcctagctttttgaaatcctacttcttttctgtgattttgagacaaaataacttcttcttttctttttttttttttttgagatggagttttgttcttgttgcccaggctgaagtgcaatggctcaatctctgcccactgtaaccttggccttccaggttcaagcaattctcctgcctcagcctcccaaatagctgggattacaggcatgtgtcaccgtgtccagccaattttttgtatttagtagagatggggtttcaccatattggtcaggctggtctcgaacccctgacctcaggtgatccacccacctcggcctcccgaagtgttgggattacaggcgtgagccatggcgcgcagcccaaaataacttctgagactcttaaagacacataaattgaagttggccctgtcttcactctttatctgccactgccctccctgctccagatctattctctccccttctttgctgcattttgtaccctgggaggctgattgctaggaaactgcctcccttggccttctctgctcctagcttcctagattcagcagatagaaaataccagcaagagatgaaagtgtggaaggcgaggaaagtcaaggaattcattcccctgggtccctcactgctttgctttaggcccgtgtccttggcaggggctgtgcaccttcaggaccacagctcattgtgtcctctcagctctggtgtgggtggcctcctgctacttccagtctctaggtgcctcaacacacagctgtgctcttagctctacccacacctcgaaacgcagtccttggctaaagattcttcatttttaatatgtgagttgaattctgtttcctgccatgactctcactggtccaacttttacgtagaacttctggggaatagatgtcatgaaagagatggccttttgtacagtgtggacagaagggccagtgatggcatttagtacattaagaagaacaaaagccagttgttgatcatttactacaggtaagccaccaaatcaagtcctgaagaactgcgagacatatttctttttcctcagagtgcttagaatggaatcgaggagatcgatggtgtacgatagaggagttcagaagggagcgagatccctaaggcttgagcagtaagggaaagtttctgggctgcagcagaggacatgagagaattcaggtgtattaagtgttttctgttggccaggcctgttacccagagttttgttctctcttttatttctcttatttcttttatctcatggtcgcttcatcttacaggtgaggacacaaaggctcagaggagtcaagtaatttgtctgaagtcatagatgtaacttgtgaacctgctgggatttgaacctagttttgtctgaaatctaaagctcatgctcttttcattgtaaaagcaataaggagtaagacacggggcttcataaaggagagatgttgggagaattgtcagggaagcaggaatgtttgtgatgtttggagtcattaatttctgagagaaaataaaagacatacaagaagaatcagagtgtagcgagggctacagggtttccacaggccagtctcttcatatagaaaccaggtgagtgctattgcctatgatgcaaagccaatgaccaacagatatgatgcagaagaaagattgtacaagatgaaagtcggccatccattagagtggaattgtccggatgccttattaacggttggtgaaaatatcctgaatataatgaattgccatttttgcatcgatctaagtacaaaaagacaatgtttagacaagaaatagttaaatgttttatcatcccatatcccaagttaataacaattagattaaaatttagtccaagggattgtgtgctaagataatatatttcaacatataaatcctaagtacttagatttacacaccacctttcttccaaagagttaaaggctgacaaccaaaaaaagggagatcagtcgaagtctcagagcaaaggctagtcttagaattaacagaattaaaccaatacagatagaacatttgtcaattaaaagtgctcaaaataggcattattccattcctgcctcacaacaattttgtaagcaagtactgttaatattatcacttggccaggagcagtggctcacatctgtaatctcagcactttgggaagacaaggtggaaggattgcacgagcccaggagtttgaaaccagcctgagcaacgtggtaagacatcatctctacagaaagtttaaaaaataagccgagtgtggtgatgcacacctgtggtcccagctactcaggaggctgaggtgggaggattgctttagcccaggccaggaggtagaggcttcagtgagctgtgatcacaccactgcactccagcctgggtgacagagcaagaccctgtctcaaatataacatatacatataaatataaatctatattttataataaaaattaaaatacaaatatataaataataaaaaagtaatataatatgtaatatatacaaatatataatgctataatatatttacaaaaatataggccaggtgtggtggctcaagcctgtaatcccagcactttgggaggccgaggtgggcggatcatgaggtcaggagatcgacaccatcctggctaacacagtgaaaccccatctctaataaaaatacgaaaaaattagccgggcgtggtggcaggtgcctgtagtcccagctactcgggaggctgaggcaggagaatggcgtgaacccaggaggcggagcttgcagtgagctgagatgatgtcactgcactccagcctgggcgacagagagagactccgtctcaaaaaaaaaaaaaagaaaaaaaatacatatttacatacatttatatataaatatatttacatatataaattttatagtctatacagatatataatatactgtatatagtatcatcaaatatataaatacatatttatacataatatttatgtatttatatatgtataaatatatatggtgataatatataaatatacttatttatatatcatatttatataatatatataaatatatatggtgataatatatacagatacatgatcacaactttccagttgcctggttctgagtttgcgtctccttattgaatgggaagaatgagtcttctatgcctggtgttagggcttcttaccttcctctaggctccaagtcactttcttcactttccaacacccttctttttgtcatagtcccttacttttagcagtctggtctccttgcctgctgatgccttcactggtatgtaaggccgttgctgatgataatttaaggtatcatctttccagggggttccaaattttaaaaaaaactctgaaatgagtttcaatttaatttgattcaatcaattcaatttttaaaaaaattggagctttactggtactgtcacagttgataatattggtcacatggtatcatattctggggtaaggaaaccccacataccacgtacttttaaagaaaagtctgggccaggtgcagtggctcaggcctgtaatcccagcactttgggaggctgagatgggcggatcacctgaggtcgggagttcgagaccagcctgatcaacgtggagaaaccccgtctctactacaaatacaaaattagctgggtgtggtggtgcatacctataatcccagctacttgggaggctgaggcaggagaatcacttgaacccaggaggcggaggctgcggtaagctgagagccattgcactccagcctgagcaacaagactggaactccgtcacaaaaaaaaaaaaaaaaagaaaagtctcgtccaggtgcggtgactcaagcctgcctgtaatcccagcactttgggaggtggaggcgggcagattgtctgagctcaggagtctgagaccagcctgggcagactgaatgaaaccccgtctctactaaaatacaaaaaattaggtggtaagcgcccctagtctcagctactccagaggctgaggcaggagaatcacttgaacccaggaggcagaggttgcagtgagccaagatggtgccactgcactccagcctggacaagagagcaagactcagtcttgaaagaaagaaacgaaaaagaaggaaaggaaaggggaaaggggaaaggaaaggcagtctgggcatggccatcagaggagcagagaacatggcatagaccttccacaatgcagtggaggtggagtagaagtgttttgggtttgctcttggctttttttctcctgtagatctgttttctttttttatgaagaggccatgggtttggaggagtggacccttgaggtatctgagcttggctttgctgccgggcttaaccttaacatcccatactcctccatcttcttaagggaataaaggaaaggttacagatggatggctcccatcatcacattacagtggagaaacatcaccagacttactgctttcaaagagtaatatagaaatgcaaacttgaaaggccacctccaaaatcctgacatctggccctcccacaaagatgtccaaaggaagaaaaaaattgatttccataaagctggccctttgcaatgtgcagctgtcctcttggttacaacagataatttttcctagattagcagcacaatgttgatttattgggtttagcataaaattcctggaatggaaagtgaaaaagatgtgagatgttaattgttttttttcctccctatttgctaggaaataactcccaaaggtctcaggaattatggtggaaattctcccctcttgtctttgctgactcaagcaaagggcaggcagtacagagttgaactccgtccttaactcccaagaatctcaaatgataagtctctcctggacactgcacggggaaaaaagaccattcccatgggtggaaagcaggttgtaacaaaaaaaaaggtccagattgtgcttcgggagtaggggaagactggttttcaatgatagtacttactggacaactttttcccactcctagcctggacccaacctgaatatttgaaattgatacttttccagaagatccgagccatgtgtccctgtacttaaatagagaccaaacttttgagaagtaactcttcccacatgtagaaaaatgaaatgcttttcttccaccatagtagtaaaagcataaaacaattctccacaggagtttgcagatgggatcaataatttgtttttttcccttttattgagatgaaggtaaattcctaaaacagacttctttttatttgctattattttacaatttatttttattttttgtggagatggtggtctctctatgctgtgcaggctcatctggaactccagagctcaagtgatcctcccatcttggcctcctaaagtgcggagattacacatgtgagccaccatgcctggccctaaaacagatttcattccttatgcttaaatctgaatgcatattgcttttccttcgttcttcagcatcatgaatgaacactcacactgttttgacattggtcaagttggtctcaactccagcctgggcagtctgcattcccaatcaatgcatctacatcctgtattcaacagtggcgtagaaactgctgtgctccaaattcagggtatgcagaattttagtccttcccttttatgtgaaagttaaaatttaaagaacagtaaaaggtaaataagtcataatttaatataaacctcaggcagaggctatgttactcatagctttgccatctggaattttgataaattagatttggattatctcttacagattgtagtttacctttaaagaggccaaatgctatttcctgtcagttttcttaactacctgtcaagcacaattcctcctcatagcctaggactgattacagtgaaggaggtttaggccacagctgatccagccatcatctgctagccaaacaaagtggttaaaaatcagtgcaattctgccatcagccaaattttagaatgaaatactttaggggcagctgctcttttaccagaaaatcatatagctttagcacttccttgctgtctgagatttccagacccccttgatatggtttgtctttgtgtccccacccaaatctcattttgaattgtaatccccatcatccccacttgacgagggagggacctggttggaggtgactggatcatgggggcggtttcctccatgctgttcttgtgatagtgagtgggttctcatgacatctaattttttttttgttgttgttgttttttaagatggagtctcgctctgtcgccaggctgtagtacagtggtgtgatctcggcttactgcaacctccgcctcctggattcaaacaattctcgtgcctcagcctccccagtagctgggattacaggcacacaccaccacacccagctaatttttgtatttttagtagagacgggctttccccatgttggccagaatggtctcgatctcctgaccttgtgatccgcctgcctcagcctctgaaagtgctgggattacaggcttgagccaccgtgccctaccaacatctaattgttttataaggggctcttcccccttggcactctctctcgctttctctctttctctttctctgtctctcatgttgccatgtaagacgtgcctgcttccccttctgccatgattttaagtttcctgaggcctccctagccatgcggaactgtgagtcaattaaacctctttcctttataaattatccagtcttgggtatttctttatagcagtgtgagaatggactaatataccccctaaaaaaatcccttggaaatgaacaaattccatctatctgtatgatagactggtgagtcatagagcagcccagagaaacacaatggtccattatagagtgagaagttgtaggtgttaaagaagatcacaaaggaaaccagttcttgctttcagctcagcctacatatcctggctgtgatctccatggcacaatcagaattttggaatggtgctcattttaatcttatgagtcagggcttatgcgtattcattaaaacaccacaggaacaggtggtatacaaaagcagaaagcaagagggggtacagagagcagtcaaacattttttccagtgaatgtgggagaaagagaggagagaggaaaaactatgtacatttcgggaatttcctctggttgttttgtgggcagagtgacattcaaggatacaggctcagatggggttataagccattgggggttacaattagacttctagttccatttgtcttttgctttgaggagtttctgtggttttctctgggagagtgatagtactggtttgggatctctctctgtgttgaactcttccaggtccttcttgagaagacatgaataactctgcactgtctttttccataacttgagaggaattaaaaaataatatttaggccaggcacagtggctcatgcctgtaattacagcactttgggaggctgaggcgggcggatcacctgaggtcaggagttcgagaccagattggccaacatggtgaaaccccatctatactaaaaatacaaaaattggcagggtgtggtggtgctcgcctgtaatcccagctactcaggaggctgtggcaggagaatcacttgaacccaggaggcggaggttgcagtgagccaagattgtgccactgcactccagcctgggtgacagagtgagaccctgtctcaaataataataataataatatttaggcattttaaattggacaagcacacaagaacatcgctgctgtaactgggatggactcagcacatatgttcatggatcttcccactcatcttgctctcacttggcttttgcctggctgggaatggccatctgagccactggtacatcagtgtgtaaacctgccaagttcagcttgggtctctgtcttccataaagcctgccaacccacacatctggacttccttctgtcactgctacacagattccatatatgtttcctgaatgtttttgtgttccacctgaaacaccagcaattccaattgtgggattatatctttagtaaatgtcttctatagccacgtggcggcaagcacagagtagcacacagtgggttcttgggtaaatatcggtcaaaggtgtgagtcatagagaacaattagagctagaaatttattgccagaaagaagagaaaggaaaagcaggactgtaggaggggtggggaaactcagcttaaggctacccaactgaccatttgcttgtgaaatgtcttcacctgttttggaggacagcggaatgtgtatctgtttccacgtctaacagctgaagggtaaaaatatctcagtttagagctctttctcaggcatcaatctggtcatttgggctgcccttctcttggacttagttattccaggtgtaggatacgggggccacttgtgcaccagaacagaaggagcccctacgggggacgtgttgagaagactgtgtgggcatggagaagtggttctatatggaagtccttctaaaggccaagataagagacccccttcacccccccaccccaactcctctcagcatttttagagactgggaagcatttcttgacagtgctttgtttctgaaagaaagcaagacagaaaaatttggagtcactatccaggagatactttgtcctcctagagaaaataaggctcagaaacagtggtctgagtatttgtcttagaagaagtggatacaactgaatctgaatgaatctttctcccatgatgaaacaaaaaattccagcacaaaatctgtgagaatctttgttgtgagaaatgtgagaaaatgaaataaattttagccctgatgaaaaaaaaattgttaacccaaaaatgagcggttactaaatgtaagacacagagatgtatgtatacatatttatatacacatgtatagataattgacacattatatatatgatgtgatctaccacacacacaggcctacaggcaattgacaagtaggaaatgaggaagtcaatcagtcaatcagtttcaaggactctgctgggtgatctacattgttatgtgccctgaagggtaaatataaagggacaggtgtccagattgccctgccttagaattagctgcctttttttttttttttttttttgaggcggagtcttgctctgttgcccaggctggagtgcagtgtcacgatctcagctcactacagcctccgcctcctgggttcaagcaattctcctgtctcagcctcctgagtagctggtattacaggcacccgccaccatgcccggctaatttttgtatttttagtagatatggggtttcaccatgctggccagatctggaactcctgacctcaggtgatctgcctgcctcggcctccaaaagttctgggattacaggcgtgagccaccgcatccagctagaattagtttttaataaagaaaagaggctgagtagaaccttactaggacatcaaatagtcctggtcagggaaatagagacagtaagaacagagatgtaaccgctgagttagggacgctcaaacgcactgataggactgcaaatcctatgtttggatgcggccagcccttgcaaatgtagagcagtctgtgagtaatttgaggagattctgctgtcctcaaatcatctcctgtagccatatttcatgacacttcctctcctgttctaacatttgaaattctcccctcggaggactacttcagtctagataatgaaaataaggtcattgctaaagccctcaattccactgtttttcagccttttaaagcctatttttttcttggccaacataaaacatgccttcctttaatgttatctgatgttttaaaataaaaaagttgcaactaagaacaatgcaaaaattttatttcgttcacttcatcaaactacgaagattcccctctctatcgcctcccattttctgactgaggagtgtgacctggatgcagagaatgtgagctccatgtggggagtggctgtatcttgtttgttgctgtttccccaacttctagcagtttttggagcaaaatcagggctcatgtttgtccttccatctggaagatgtggctgtggctgtgaatctggatgaatcttgtgccatgaggagaaaatcaaggcataaaatccgtggggatgtttttaacacagagaagcagaagtgatgggtctgtgccttggaaagtctatgacagtcttcatgggttgatgttttccaggcagcactcagaaagctgccctgagtggatgagctaggaggtccataatttccatagggtagaaggacagataacagtaacaagccaccagtggccacgtaactgcaactatgatcagagaaacaggtgagggcagtatgggtcttagaacaggtttcagaaactcaggctttggtcaagcaagaggggacattgggtactacggggatggaagtgacgtacagaggacagtggcgtggagtgaaaccgatcatctagccctctgccccagacacccccaacttcttgtcatctccttatgcaaggacccaaagttcttctgactggctgcgcctccagcctcatctcctgttctgtttcctcttgcctgcagttccagccacatggatctcggtgctattgctcaaccatgctgcagaatcactaccatctctcagcctttgcccctgatgccccctctgccgggaagcctctttccctagatactgacactgcttttcactcactccatccaagccccgcccagattcaccttcccagaggtcttccctggacaccccatccaaaccacaccctcttttcttctctttctatcctcctctcagttgctttatttttctctgtgataatcctcactctctgactttacatctactgtatatctatatctatacacacacacgcgcgcatttgtttattgctttttccccctactagaatgtcagctccctgctatatttccaggtcctagaacaatacctggctcacagcatcttagtaaaatgttcgtgggacaagtgactaaagcagatatggttttgaatccaggcctggctatgtattggttgtattatgttggaaaattacttaatcttcctaacctgactttgctcatttgtaaactaagttgattatacatttctcaatagactgtggtaaggatacagcacacgcaagcctgcctgtgcctagtgcatagtcagtgcccaataaaggctgtgatttcagcttggtttatattttaaataatttgctctttgttagctacagatctgaagagatttccagcccaaatcctgttctgtactttttcttgagccaggagtgtagggtggtggtgaatcactgattcacaagtgtgatggaaatatgttttagtgagatgcataaagaacaaaaaaaaaaatcacaaacgtttgacttttcttaagaataacatactatctatcttttccttgtgggagagatgttatgaccttccgtattatttcagtttatggaaaaaacatgtgagtgtgtgtatgaattgtaaactcacctccgatcagcctctgagggatgctggatctatgatacactttgtccttctgagaacaaaactcttcccaggtaaatgcgcttggaacatacatttatttctgtcttaacctgatttttgatcgtgttggaggatgatgacagttgggaagtataaaaggaagaaatctaagaatagaaagaactagatcaatcttagtgtacttctggagagacagacaatgcttgaaattgtggttgtagagacctagtttgttaatttaaaccatcatttgtctattttttagaaaagactcacgaagaaattctaacggtgagtaaagcaaatcttatggccccaaatatgccagatatgccagataaaattaatatttttttcctgaaaactgttttatatcatgcagtgttgcatagtttgcttatctgacaatgtgtatcttgggatactggaacatcagtcacaggagttactattttcttttagcataaaaaatttaaaaaatctttagagatgtagttctaaaaaaacaaaaacaaagtaagaggggaaggcttgctgaagaaaacatgaccttttaaataattcatctacagtgcttcttgaaactagagaaataccgtgtatggggattcatgttttataaaatatcagtgagaccattatttgctgaaaatgtttttctggcactgattaaaattattaattattttacttttctcacttagattatctaatcttaacatttcttttcttgtttcttctaaatcctatctctcaaaaggtaggattaatttatcttttgcttacaaaaacaatatctgagtggagccctggattgaaattcaaggactcactaggtgtctactaatgtagtagggataacattgagtgttacagcttggaagctgattacctttatgacatacagcttggaagctgattagctgtgtgacactgggtaacccactgttattctctgtgcttctattatttgttctataggaataagataatgctgaccaaatgatatactaaaaagcatttgtgcagctgagaaaataaagatgctgatgcgccatattattgaagaaataattcttgcttttgtgtctgttctaggggaaaagattaagagaaagaactgaaaattgaattctgttctacaataaaagtgtagctgccaggctcatccttagagcccgcagaaaataaagaggtgccatggatccggcaccaatggttctttctgacagaggcctttggccttccaagcccctcactctgctggcctattggagaatgtgtgctgattcccagaagagcctcatgccctttctgcctcctgcccaggtcctggaagttttcagagaaaagggtgccattatccaagtctaataattttctattttaaatgctgaattttattatcgggtaatcatcattgtggaaaggcaaagccattcactaataggaagcatactataaattcatagatgacatttgctcatgttttcctgtatgagatctggaagccaagtgtttaagcatgcacccactcccccacaactttttttttttttcagatggaatctcgctctgtcaacaggctggagtgcagtggcgtgatctcagctcactgcaacctccgagtcccgggttcaagcgattctcctgcctcagcctcccgagtagctgggactacaggcatgcgccagcacacctggctaatttttgtagttttagtagagatggggtttcaccatgttggccaggatggtctcgatctcttgacctcatgatccgccagccttggcctcccaaagtgctgggattacaggcctgagccaccgtgcctggccgcacccaccactttttaacatcatacaagattaagctgaaaaataggtgattactaaatttgatattctggagatgtgatggtcatggaagatcttttggcataatccctccacctgttgccttgggtttggtccttcttatttcctgtctaggtaattgaagtggcctgcacttggacttccttctcaatagcccttcatctgctctcacattgttgccagagtgctcttctcaaaacacaagtttgatcaagtaatgtttcatttaaaattctgggctgggtgtggtggcacaatgcctgtagtcctagctactcgggagggtgaggtgggaggatcgcttgagcctgggagtttgaggttgcagtaagctgagattgcaccattgcccttctgcttgggcaacagagggagactctgcctcaaaaaaaaaaaaaaaagaacaaaacaagaaaattcttcattgcctcctcattgccatcagtctaaagtccagatttcttaactaggtgcctaatgaagactggtcttgaaaaaattgtttgaacttgcaaaatattgtcattggaagagttacaagcagggtttttgtttgtttgtttgtttgtttttgccttctatgaatagagactggaatttatttttgttcagactatgttcagaaagagaccattctgctagtcacctttggttatgcagaagtagtaggaggatttaaatattattcttgtggctggctgaaattgacaagggtcccagtgaaaatgctcaaaatgggatgctaaataccctctttaataatgcaatacttataactaaaatttgttgagccagattctatgtgccaggtactcttgtaagctttttatttgtattaatgtaatggctgatagtaattctgttacaatcccttgctattgatgaaatggagacacagaggggttcaatagtatgcccaaggacacacagataagtaaccagtagaattcagattggaatccaacacgtctagctccagagtcctcactctcaagcactgtgtgatagagcctccattgcataagcagggctaagccctacagaattagaaacatccttcccacctaccaaatctggatgtctcatggcttcttttactaagcatttgcatgtggggtgtggaatttgaagctagagcatggctagaggaatgtgctgccttagtctcttcaactcactctggaggaagaactgaaaaagtacagtgcagtggggactaggatattggtgtcctacattggtattacataaggatgaataactcagatattgaggagtatcctgtaaatagtatgtttgtcttatttgattcatcttatttcatattcttttaaattaaaaaaattaaatttatttgtattggtttttttaagacatgggatcttgctgtgttgcccaggctggggtgcagtggctagtcacaggtgcagtcatagcacactatagcccataactcctgggctctagtgatcctccctcctcagcctcccaagtagctgggactgtagctgtgccaccatgcccaactagttttactagttttgagagcaaacaatgggatattatttgtaggggctgactattcccactgtcaatcattttggagaaggaaattcaaaaataggcatttaaatcagtagagaaagtttttatttgggcggggggggtgctgtcagagttggacctaaacaaatacatggccatttagggggcatccctttggtggaggttgaaccagcctgctgagagcttggttgggattaaaggattgggttgggccattgggctccaaggtcaattctttctattagctgttgtaaataaatctgttaatttgtccttaaccttccaatcttctgtaaagttttgttaaaggtcatggttaggtatgatgactcatctcaaggccagagaagagatggcaaaggccccatctatctatcttcctctttccaattgctcctctccacatagaagcaattggattcccacccagcacagtgcattctttcaggtctccatgctttgtcgcactctggacttggagggcctgttgttgacctcccaatccactttgttttcagttatactttgctgcctgcagctggggcttacacattactaaggattttcttcatggcaatgtttgttacaatggaaactaatcatccaaagagatcctgttttcaaatcctctttccacatcaacagtacttgaggatgtacatctaatcaagtgatttcagaagaatatttaggttaacctgctggcagctcatgcccagggtctttggtgatgtgacccttgttctttgtacatttttggtcaacatctattgattgagtgtatatcatgtatcaggtatggtttaggtgctgggtctacaactgtgaacaagacactgaaatcctggccctcacaaagagtgaatgctattgggagaaatagacaataaataagaaaaataaatagaaatataccacactaacaagcaaggcagttttgtacacttaggcaggttgtgcattgcacaagtgtaccacaatctggaggggggggccgtgacagtgttgacatcagagttttgtgaactatttatttctacagtgttcttgcaggtgttcttggggaagatcatctttttctaatttgcacaaagctgctgtatgagttaatggtaggcctattagtaacgagtgagcctattaggaatctgttgccaacattcaggtaagaaatgatggtagcttggtttaggaagtggcagtggaagtcgaggaaagtctgtgtttaaattctgtatatattttgaaaatagagctggaaggatttgctactgactggatgtggcatttaagagaaaaattagaattaagattgctaccaaagtttttggcctaagcaactagaagcatcgagttgtccttaactgaggtagggaggatttcaggaggagttggtttgggggtcaaagatcagcagctatattttggacgtgttaaggttgagatgtctattaaacattcatgtggagctgtcacataggcagctggatatatgagtctacaggggagaaacatgtccagactgaagatataaattatattactttaggagagctaccataagccataatttgtcctttaatggatgacaatgttggcaaatacataatttttatccaatatttgtaataagttcttccctattatatacttttctatcttgtaatacaaactgaataaataaatttgttttagcttgtcattctgccttggaaaagtttgaaaaatactttgaacacatcattcctgaaataatttgctcttataaaattataaaattaagactaagacaagtctttaaaaatttagttttagagaaaagagtaaatagacctctctctagccattgaatttttacgtagggaacttgaatgtgactgtatatgataactcactggaattattttatgtggcaagaatgagatttactgtaaatagtatataatatcatcaattactatatgaatctctcaaacactgattatagtgtagcaggaagagccacagacaaaatccctcagacaccaagttaaagaaggaagggctttattcggccagaagcgtcggcaagactcacgtctcaaaaaccgagctcccctagtgaacaattcctgtcccttttaagggcttacaactttcaggagaactatgtgagagggtcatgatcaattgagcaagcacgggttatgtgacttgcgactgggtgcactggtaatgagaatggaagagaacaggacggggattttcacgatgcttttccatacaatgtctgaaatctgtagataacacaagcagttaggtcaggggttgatttttaactaccagccctggggagcagtgctgggctatctgcctgtggattccatttctgccttttagttcttctttttttggagacagaaattgggcataagacaatatgaggggttgtctcctcccttaataggagttttcaaaattggcaaaacaaaactttataaagcaaaataggaatgttttacaaaacgaaagaaactactgccagctttgtcagtataacaacctgttagcaatagagggtgatttataggaatcagccatacgtgtacagtgcaccaactctttattattcacaagtagatgatctatttgcagatttcctgtagtttcatgacctgtgttctctcataggcagaagggaattcagtcctgatgcacacaagttgaatgtctgtgtgtatcaaagtggttcctaaaggccattctcattgatttctggacttttaatatttttgtaatattttcacctctttagcctgcaccttgtgcaatcaagggcacttaggaaagaggattgctgcaggcaacttgatgtgtttcagaataaataactccacagagatcgtactttctgtgcaatacgaaacccaaactgatttttttggtaacaaaagaagtcttattggtttccacttttataaatccaagtgttcatatattgaccttgttattcctttgttttcggtggcagttcacctatattttacattacaatgtggtgcttgaatagccctttgtaagttgacttaaaaaaacaaaacaaaacaggcctggctcagtggctcacactgataattccagccctttgggagaccgaggtgggtggttggcttcaacccaggagtttgggaccagtctgggtaacacggcaaaaccccatctctatgaaaaatacaataaaaaattagcctggcatggtggtgtgcgcctgtagtcccagctgcttgggaggctgaggtgggaggatagcttgagccccggaggcagaggttgctgtgagccaaaatcacgccactgcactccagcctggtctacagcgagaggtcctgtctcaaaacaaacaaaaaaacccaaaacaactttattgagatataattcacatattatacaatttatcatttaaagtgtaaaatttaatgggttttagtatactcactaaatatgcatagggctatgcaatcatcaccacggtttagttttaggatatctttatgccccctaacaaagcctagtacctaccagcagtcactctccatcctccttttcctccatcagccctaggccaccactaatctcctttctgtttctgtgactatgactattctggatatttcacataaatggaatcataaaatcggtggtcttttgtcattagcttttttttctcttagcataaggtttcaaattcatctatgttgtagcatttatcagcacttccttttattgcagaaaatattctattgcatgaatatgctacatattattcatccattcatcagttgatagacaactggattgtttttactttcctggctattatcaataagctagtataaacatttgtacacaagtttttatgggcacatatgtttccatattctttggggaatatacctaggtagaatatacctcagctagaattcctgagtcataaggtaattctaactttttgaggaactgccaaccctgttttccaatgtataaattggcttttaaaatattacctgtactgggttgggcacagtggctcacatctgtaattacagcactttgagaggccgaggctagtggatcatgaggtcaagagatcgagaccatccttggcaacatggtgaaaccctgtctctactaaaaatacaaaaattagctgggcatggtggcacacgcctgtaatcccagctactcggcaggctgaggcaggagaattgcttgaacctgggaggtggaggttgcagtgagccgagatcgcaccactgcaccccaacctggtgacagagtgagactccgtctcaaaaaaaaaaaaatttacctgtactgcttccattctctgttaaagtgaattttatcattaatttatacgttttctatgtatcatgctgttacatgtacacacccactttgcaaaattgttaccttaatcacgttttgttaatatttattcgaatggcaagagtgcctgtttgtctcagtcaaatgaatctttagagaactgtttcgttcttctgaggttgcacaaaattaatgtggtttaaaagttttaatttaaatttaattttatttatttgcgttttgactaggtattagagtgacctggttcaaaatctggaaacacaataagatacatggtgtattgtccccctccctcgtctgtgctaccgatgcccagtttccttccctggaggcagccagtgttacctgcttctgtgtggtcttccaaggaagacgttttagtgcagttttaatttgaagagaacaacttaaaaaaatgtgtacgtgggaatagaagggctttgttctaaactccgttggtttgtttggttcatgaaagtcagaacagcatgactttatttcaaggttgaataacaataaaagatttataagtttaataattgtcttcaatagcttgaggacataatcaaaacaactgacttctctttaagtcttatttctgccccaggaacctgtccttgatccaccaccttctggttattatttcactttgttcacattccggggacatacaatcggctgattttatcttctctaactacatttctgcttcagaggctttacttggtgggaatcatcttccagactccccaaagctggcttctgcccaactcacaaacctcatctcacatgttgctcttttcccctctttcaccagttccaggcacacagacttcctgtcagttcttggtcaagcaagttctcgtccacctgaggaccttgtccttgcctgttcttccgtctgcctggaaggctttcttctgtcttctgtgcctggctccttccccaccttccggcctcacttgagatgtgatcttctctgaccatcttagctgaagttggcctcctctcccttaatctccattgagctaaacagtttctttcatctagaacttactatagtaattatgtgtttactagttcactgtctggaatcgtttaccctagagcagtctacgatgtaaagccaggatggtcaaactacagcgcaagctttgtttttgcaaagctctggaggtaagtattgctttacattttaaaagggttgcttaaaaattttttttaaaaaaaagctaagaagattgggcagcagagacttcgtgtggtctgcaaaactatttactatccagtcctttacagaaaaatgtgctaatccctgggctaaaacaatggtctccaaagtgtggtatgtacattccaaagattgtgcaagataattcagtaggttcttaattatttattcttttgcattcatttattgcttatgttttataatgcacataatttttagtatagtaatagatacatataatttataaattaacatatacatacatgttttgggaataatgctcagaaattttttaataatgcactttatgataaaaattttggaggcaactggggttaaaatacaaaatttatgagggcaagcgccatattctctccttccatattcccaccatctaatacacactcaatgtaatgctttttgaataaatgatagcagtagacttaaacatttattgagcacatattaactaagctctcggaatgtaatatcttctttaatgattagagccaccctatgagttagatcttgttacttttattttacaaacgaggaaactgaggcccagagaagtcaaacaacttcctgaagctctcacattactagtaaaaactggaagctgagtctgatgccagtctgactccaaagccagtgtttttaaccatgaatgacctgtctctaatttcattctttttttttactctttatgtgtatcagaatgcaattacattttgaaaccttgtgtgtcttgatgttgaagacatattggcttagaaggggtaatcaagtttcccatagcagtaaatgaaaataaagaagggcacttatcccatatttctaatagaataagtcactttcaacggtttttttttttttttgaattcttggagtcagaattaagaaatctgtggggtttttttttgttttttgtttttctttctgagatggagtctcgctctgtggcccaggctggagtgcagtggcgtgatctccactcactgcaagctccgcctcccgggttcatgccattctcctgcctcagcctcccgagtagctgggactacaggcgcctgccaccacgcctggctaattttctgtatttttttttagtagagacgggttgcaccgtgttagccaggatggtcttgatctcctgacctcgtgatccacccgcctcagcctcccaaagtgctgggattacaggcgtgagccaccgcgcctggccagaaatctgtgtttaagtatggttctgcaaatcatttaactccattaaggtcaacttctcatctataaaatggagccaataataatgtttatcccagaggtggtttccaaggttacgcacatgtgaaagtgatttgcatattaaggttgataacagcggtcccaacctttttgggcaccaggaactggtttcatggaagacaatttttccatggatggtggggtgatgggagatgggaggggaatggaaggatgggtaggaggggaaaggggatggtttcaggatgaaactgtttcacctcagatcatcaggcattagattcttataaggagcacacaacctagattcctcacatgtacagttcacaatagggttcacgatcctatgagaatctaatgctgctgctgacctggcagggggcagagcttgggcggtaacactcacttgccagtcacctcctgctgtgtggcccagttcctaacagggccggtctgtggcagcgggggtggagacccctgccttatgggactagtgtttgggaagaaacacccctggtgtataaaatactagtctttcttctctagtcatatataactatgtagaggcatacttatctctgcccccttagttttattactgtaacatgctttgcttaacaaaccagttggttaactatttaaggaaagcatcatcattctggcataggaaggattcaaaacccaagtctaaatttggcattcagttcctaggcttcttataaactctcgtctacttggtcttagtcaaaagtgcacatgactactatctgcgatgcagatttgaaagagagaacagtagcatttatcagcatctcctttactcacaggatcggaacatgaagaacacaatactttagttgtcatatccatcaacattagaattaaattggaagttactatttagattttgccagcgcaactcctacttatcagtcttaaaaaacaaaatccttcaagttttctttgtaaaaaccatagcttttaaagcttattttatattaaattataaaataaaacccaaagcatgtatcacattttcacttcaaataatataatttacacatttgaaacctgagctcccgagaccataagctaaatctgaagtcaaaactttcaaaaaaaaaaaaaagtcacgttaatcattctcacagagttctgaaagttttgccatagaccctttatctttttccttccctacaagtgcctggtggcttcccttctacgaggactttttgcagtagaaacaaggtcatgtctttcttttattatttgcctttgtgttgccgccagttttaggaccttacttagaaattcccagtacatggactatgttcaccaaaacttgtaaatatttgtaaacctgtgttctctaaacggttgtaacgattattgctacatggtccatttagcaatgaatcatggtctgccccgtgacacattttctctcttgacctgagccattatttcaacatttcattgttatttaatttaattttttttttttttttgagatggagtcttgctctgtcactcaggctggagtgtagtggtgtcttcttggctcactgcaacctccacctcccaggttcaagcgattctcttgcctctgcctcccgagtagctgggactacaggtttgagccaccacaccaagctaattttttgtatttttagtagagacggaatttcaccatgttgactaggatggtctcaatctcttgaccttgtgatctgcctgcttcggcctcccaaagtgctgggattacaggcatgagccaccgcacctggcctcattgctatttaattttacatgaatgtgtcttgttttctcaaactgcatttcggggtctttaaagtccggtccacttgttaatttttaatttaaaaaaaataagaaaataatttttgcagagacagaatcttgttatgttgtctaagctggtcttgaactcctggcctcaagcgatcctctcacctccactgcacccagccccacttgcttatttttgaattccacagcatggagcagaatttctgacaatagcagggtcttgggttaccagacttgagtttcaaatccagctctattctttactattcatgtgaccctggtcagtttagttaccttcataagcctttttcttcatttggaatgggaatgataattctaccctgtgtggttacaattgaattatatgattgtagggtgggcctggctgcagcatctcatggttccagggctgccatccatgcagaccactgtgtgcatggcactgcctggctagggggcctggtacctattaggaactcagtagagggcagttattgctatcactgaatcccgttcacttgattaaccaagcataaagaagacatgcccagcagaggcaaggttgaactgtgtgtaagttgttggcggggaaagagctacctttggctcaaggcctcgtgaagctacacagattcaaattctccttagggacaagtcagctattttgtgaagctataacagctattgtgtcagtaaatccttttaaataaacagttctaatctctgtcctatggtagaaaggttggaaggtgagaaggaaatgagctaccatgttatcctgatcctctgacccttggattctcttctccagtctgtctttgtgagtggacagatgtcagctggtactacccagcaaagatagacacaagcttatggtgagtttgggcattttcagatgtttttaaatgtaagggcatccagattctgaatccaatttttatggttagcaattggttttagtttataacagcaaaaaaagaatatagtttggatgggatgaaagaaggaaacagaagtgttagaaacaaaatgcttgttccttggtgctgcaaagaaatagcacatgaacataaatttaattttctcagcaaggcaatttttacttctatagaagggtacgactcacaaatggagtaatggcgagagcgcacctgaacaagggaggggaaggggttcttattcctgacacaggtggcccctactgctgtgtcgttcccctattggctagggttggaccgcacagtataagctaattccaactggctattttaaagagagcaggggtataagccagagtggcggggtcagtagtttggtaggaaggatggttaggtccaggtaattaaaggtgacttaggtcagagcaggtgaccggggtgacgcaggcaggtcaaagcaggtgaccgggatgagtcaggacggagcaggggaccaggggaacagatgtgaactactgattaaaactggtgaaaaaggttgtttactgaaaccacgaggaagttaaattttattatttatttatttatttatttatttatttatttatttatttgagacggagtcttgctctttcgcccaggcctgactgcagtggcactatctcggctcactgcaagctccgccccctgggctcaccccattctcctgcctcagcctcccgagtagctgggactacaggtgcccactgccgtgcccggctaattttttgtatttttagtagagacagggtttcaccgtgttagccaggatgctctcgatctcttgacctcaggtgatccacctgcctcggcctcccaaagtgctgggattacaggcgtgagccaccgcgcccagcctaactttaaaatgggggacaaaaaactgaacatactgacatattgattctttgaagagaaatctagaactcactgtaaccaacagaagaacttaaggcctggtgaatgaagtatctgaacctccaggtagatttttagtaagcacggagcctatgatgggtactggtttaaagccctaagggtggtcttagtttagttgaagaaaaggaaagaagatgtccttgaatcattattcagggtcaaggaatgagaggtgttggtgaaacaggcagagaggggacgtgatattagattaatgtcacatcattgcatcctatggaaggacctgtaatgttgttaggcagttgctaagggcaaattacaggaaaaatattaactggttaatagaatcatgtagtgataatagagagctgaaggcactttcagagatgatccggcccagctctctctctgcaggcaagggaatgtctaaatcatccaggacagatattgttgacatctcaaaaagctcattaagcataaagagtcctccacattttggggtagcccatctgattattttatcatcagaaggttaaaaaaatctcatccttacccaatctaaaactcagattggttaggtttttattttcttttacacaaccagccacaaactggtgcttatgatgatggtgtcttgtaaatgaacaacaaagagcagggaccactcgaccttcttactgcatgccttctttgtctcagagaaccagtgaggttcatttgctccacaaaaatttatcaagtaccaagctctgtgataggagctaaggatgaaggaatgaataaagtggaatccctgccctcaatccatttgagtctagtgggatgggagcagacaagtagagaggtaatatttaccaggtaatgtgttaactgtagtaacgttttttataaacatgagagtatttatcaaatgctgggaattgaggactaagctctgatttttttcttatcttagccaaattcctatctaaaggggtctggagagtcatgccctacaaaccataaattctcatcagatgggttttatttaagcctatatatcgtgatttactttccaatctgactcttgcataacattatgtgacaaacaagaaaataaaaatattttatcccaaaacatgtttctttgctgtattttgaaatggccgtgcaaagctgtcctttgtggcagaaaatttgcatctgtaaagaaactctattaacatagctagatctttttcttccaggccctcccagtcctgaagaggttaacggagagtctagcaccttttaaaggtctgaataggaaacgtttgtcttctgttgtctctaagggcagccactatgagacttcaaaagaaccttggtctccagaatcttaacctgaacatgaaattgacctatagcctggaagcctgccccaccccacgagttgtcccgctgttctggaccaagccaatatatttcttaatgtatctgattgatgtctcatgacttcctgaccaccttgggtacatgttctcaggatctcctgatggatgtgccagaggccatggtcactcatatttggctcagaataaatcttttcaaatattttacagcttgactcttttcagcgacaataattgtgctaagtgcttcaggcatattatcccattcattctcacaactcccttgtcactgtcgggccgttgagcccaacctaagccatcatatcccctgtgacctgcatgtatgcatccagatggcctgaagcaagtgaagaatcacaaaagaagtgaaaatggccagttcttgcattaactgatgacatttcaccattgtgatttgttcctgccccaccttaactgagcgattaaccttgtgaaattccttttcctgactcagaacctcccccactgagcaccttgtgacccccgcccctgcccgcaagagaacaaccccctttgactgtaattttccactactcacccaaatcctataaaagtgccccacccctatctccctttgctgactctcttttcggactcagcctgcctgcacctaggtgaaataaacagccttgttgctcacacaaagcctgtttggtggtctcttcacacagacgtgcgtgacagtcacaaacttatgattgcaaaaaaaccctttgagtgcaaccttttctttctggttggaacttattgttttgtagttttggtttttttgtttgtttgttttggtctgtttattttttatttatattggcttttttgttgcctttttcagttttatttctgtggttgaaactttatggcacattctaaattcttcctggcaatggcttagtgtgaatttatgatcagtcctgctagttttgcttgttagatgtaaaggaaatttttgaggctttagaaatcccttttctctctcaaatttataggctttcaagactgttgtttctatgggtttcaaaatcctatgctggcagtcaaaaactttctttctctttgcatttctgcagtaattctaattctcccggaggcaggtggaatcctctggaatgtcatatgcaagcaagtgaggaagaaaaaagaaagaggacatgttttaacatatcatctctcttttacaaaataaatggacacacacagacacttacacagttattgactcgaggagtcgctgcacattctcatataaaggtattacatcttaactagagatagttcttaaacttgcaaaatatagattacttctaatcacgtcatgtcaggcatcaatgtactgggtaagggtttcttttcccccctgtaattttttctactttgttgaacacattgagctaaaaaatcctatacgaagttgttcctttaggtaaattagttaattttcaataaaattacagctttcgtaaaatattaacaggcacttttgtctcttctgcatttctgcattggactccccgcatatctataccacacatatgtatgattattgttctctaaagcagtaattatgctgatagtaatgatcccgaatgaccgtaaagattgtctctgattacatttaacagcaaatacaaagacactgtttttcctacttgggtatatttaacagcaaatggtatgaacgatccagacagctgtaatggctgagttgggaagtctgtttcctgaatagggtagaaattcaccactggggaaagaaatgcttccccgttacttttattgtgttactgacccatcacatatgctcaggcttccaagctgagaacgtgccaaactattaaccaaaataatacgtctggctcccaaagctcacattttgtgtaaatgcaaatgtaatcccgaggtgtattagttagcaagatggccgtctggtgggacacttggtatcatgtgcccttcccgctccatggcttggaatggaatttgtgctggccgttaacgttcttgaatgcatttccctctgagcttggatagagggtaagacagccaaatggaaacatcttctttcaggttctttggaaatacatttattgatctctctcaatctttggcgggattttctttcttcctggatgaacaggaacaactctgggagccgcttgcagtgacacgatgcagctgtgtgtatacctggatgccttagagaatgtgtcagggagagaacagttaggcagtacatctcttcctcctgaagtccagaatgtatgtgtatatatacagttctctctgcttctctgtgccctttttgtctttctctgtttatcattcaccccttctctcatcctttccctcgtctcctcccccagcacctgataaccatgttacaggatggagtaggatggagtgaaaatatgtttgctctccaggcagcatgagaaacagcagatgtactacagggtgtgggaggagagtttcagtgcacagtgcattgtacaaagaatgcataggggaggttaattgctattatcattactatttattaaaatgtaacagtgcagactgtatcatcattgatctggtgacttaatatttcaattggacaagcaggtagttttagacctaaaatattaagcacctaaaaagacatttaaaaacattattcacagtcccaaagaaaagcaataacaaaaaatgtttcattttccctctgattgttcctggatttgttctcttttctttggtggaaaatgatggtgctacctacaattagatctgcctgactctgagtggtgtggcaaaactctgttagctatttatttggattcttgaggccctaggagcctgtggtcctgttggtgtgaattgtattaggaagagaggagagataaaagatgtaaatggagatctgtctgtctacctatctatctatctgtttatctatctatctatctatctatctatctatctatctatctatcatctatctgcaaggagaaagagagactgaagagaatgcagggtgatagaaaggtagaaaagggattgaaatcattgttaaaaggaatgagaaggtacagctctaccagtctatagcataattccattttggccaggtaatcaacatgctgacaccaagctacaatttttctcctgaagcacaaaaggaaatgaaggcttgactagcactgcaaggctgtgagttaggaaacgggaaacaagatgctcctgctgctgttggagtcttgagttgttcctgaaatgagactgtggcatcccctgagaacaaggcatgatgcagaattgcacaatctaggtgcctgtatttcagctggcaaagctcccacctctgcctcagactccttgtcctgccacgcaggctccagacagtgacactaaaacattgctctgtatggtaatttgtctgaaaaatagctttagaactgtaccagctttatggctcaacaattggagcatttaggtgaaatttggaacccagccattaagagaactgctagagaaaaacatgacagtaaaatcaaatttcaaatcagcatcacttaccatatgggaaactgcaaattcagcaaaagggaaggcaatgctgaaattcaccttcaaagctaaatattgttccttagaccaatttcaacctcgaattcatttgaatttcctttatgtctggttacatctgaagtgaagtaattagcaataggcttgttagatttttctttccttatggaatttttttttttttcagagagacaatgatcacttatgaggtcatatttgtcacaggaatggcaaagactaaagtgattcccaccattttttaggatgagccacttttttgttttcctagcaagtttaactttattgagtttaacttcatgaagttagcatactaattaattttaattactaaagttaacccaatgtaaatacatgtttatttaatatgccattaatttaaacacagcttttataagacataattttatatatcacaaagtgcaattactatgaagaatggctttagagttagttccagttactcctgactaaagccacagccaggtgttgcctagaaaatcatatttgccttggccctgtttcctctattctttttatccagccgataccaggacatttgctgatcttccatattattcctcatcacatcatatctggagtggccctttcttaacatcaaaactttgagacaaccccccacgtaatggttactggaattacttgttgaccgaggaaatatatatatgtataaaactactgtgaagtcaggaatgcttttcttctttttttgttttttgttttgtttgtttgttttttgagacggagtctcgctctgtcgccaggctggagtgcagtggcgcgatctcggctcactgcaacctccatgtctcaggttcaagcaattctcctgcctcagcctcccgagtaactacagacgccggccaccatgcccggctaattttgtatttttagtagaggcggggtttcaccgcgttagccaggatggtcccgatctcctgacctcgtgatccacccgcctctggcctcccaaagtgctgggattacaggcgtgagccaccacgcctggcccttgtgtgtttgtttgtttgagatggagtttcactcttttgcccaggtgggagtgaagtggtgcgatctcggctcactgcaacctccacacctccccgcaccgcaccctccccactgcccctgcccttcaagcgattctcctgcctcagcctcatcctcagcctcagcctcagcctcgtcagtagctgggattataggcccccaccaccacgcccggctaatttttgtatttttagtagagaaaagccccgtaggctttttcctctttagagacagggttttgccattttggccaggctggtctcgaacttctgacctcagatgatccaccctcctcggcatcccaaagtgctgggattacaggtatgagccactgcatacgtcctaggaatgctttacttgatcacaacaatgatacatatttgaaagtagtgggaaatatatgggtgagatatatcactcggcctagtgataatgattggggagcatgtagattcacagaacactttatagtaatgccaggccccagaaggtaaccactcctgcaggagtttgaggaagaagagcagttttcgctggatgtctagggaagattccacaggtgaacctgcatttgaacttggtgttgtcagctttctctgttcctaaactttgcagtataagaatgtagccgaagggccgggcgcagtggctcacgcctgtaatcccagcactttgggaggccgtggccggtggatcgccagaggtcaggagatcgagaccatgctggctaatacggtgaaaccccgtctctactaaaaatacaaaaagttagccgggcgttgtggcgggcgcctgtagtcccagctactcgggaggctgaggcaggagaatggcgtgaaccagggaaggcggagcttgcagtgagctgagatggtgccactgcactccagcctgggcgacagagcaagactccgtctcaaaaacaaaaacaaaaacaaaaaattggccaggcgtggtggtgggcatctttaatcccagctacttgcgaggctgaggcaggagaatcacttgaatccaggaggcggaaaacaaaacgaaacaaaacaaaacaaaaaatcaaaaaagaaagtctctgaaggcttcacactgtcagattgccaggcagtgagtgggagctggtgctgctctcagtatagctgctattgggaaaaggatggttgttctactgattaaatgtgactctagttggtatttgaatttgagggacataggaacgtctccctcaggaattcttcctcaacggcatttcctccccaccagcctctccgcataggctttctcctctttaaggcagacctcatccccctattgtattatgagctctctagaggacagagcaggatctttctgcacagaagaaagtcttatggaagttgggagcggttagaagaaaccacagccatttcccacccaccccattcctttcaatggcaaaaacaataattacttttgcaccaatctaatatttatatttagcctaatagaaagatcaagttagatatatatatagaaaatgtgttgctcagaataagatggagctctttgagtctagataaccgtggatgccttggggtcactgaggggcttccggcatccaagcctgctccatgtgatattgttggttggtacatgcttgactcaactgaactatttcaatttcttgccttggaaatggaaatttggacctgaaggcagagagtctgggagttttcagagctgagtcacattgacggcagttttctaaagaagaggatcatgtactttaattcatccttcagttccgtgggctactccagtatctttccaatgacatctcactccttttttccttaagttggccagatgtgggttctgttatttggtccccccaaaaccttaattattatgtaagtctttaggacaggggagtggactatcctcctttggactgtaaatcaaatccactgaggattttaaggattcttaaaaatcagagttgcagcccacatatgccttaggaggttgtgggatttggattatcccagtgagaatctgaataaatagttacatagtctaagaccaaccttgtgttttcttagaggtgggtggggaatggctgtgctttcttccaaccattcccaacttccataagaccttcttctgtgcagaaagttcccactgtgtccttgtggagagcttatttaatgacttggcatcatgaaacttgaccaggcttatctggcttaatgccacttttatagagagacagtacttcttgtttcctcccttaaccgtcggggctggttttaggaggaatgagtaaacaaaataaataagtgctctatttaaagcacgaattttatgttggtaaatgtaagaaattttaaaaaattgttttaagtgtatagttcccaggcatggtggctcatgcctgtaatcctagcactttgggaggccgcggtgagaggattgcttgagctcaggagttcgagaccatcctggacaacatagcaaaaccccgtctatataaaaaatacaaaaattagccaggtgtggtggtgcatgcctgtggtcccagctactcaagaggctgaggtaggaggatcgcttgagcctgggaggtggaggttgcagtgagctgagatcacgccactgcactctaacctaggtgacagagtgagaccctgtctcaaaaaaaagtgtacagttgcaagtatattttaaagatacctatatagtaaaaaatttttaaaagtatttatgtaagaaaacttgaaatagatgacagtgctaatagccattctgaagaactggtggtgttatagatgctctcttccccaccatttcctgtttttcacactctcataatgtggagtcattatccctataagaatttttgaaagcataggactcagggagaaaaaataaatacaactagtctactttatgattaaaaatcaaagagagagagagagcgaagaagaagcaggggtaggagtgggataaggagagatagagagaaaaggagaaaaatggaatgagatattctcaagtgttgccagattgtcacagaaaaaaaatcttggtataactgtcttgaaaaattttaaactttgacatttttgtcttgaagtagtagaggatttttgtgcttattttcagtttatgaatgagtggtgtttgtgtcagcatcttaaacaatggaataaaaacgaatgtattcgttttttgttcagtgtaacggtttgaaatgccagataccttcagggatgaagcggctgcttctcagagaactgctccaggttttaggttgcagggttatttggcagaggtgcccactttctctatttgtctaagacagaattaggtcacacaaacaacaaagatatataagagaaacccccttctaggttcaaaaggaagtgagaaaaaaattggtataaaaaagaattctctttttaagcacattaaagtctccctttttttcaatctttttttttttttttttttttggcagggtcttgctctgtcacccaggctagagtattgtagcacaatcttggctcactgcaacctccgtctcccaggttcaagcaattctcctgcctcagcctcctgagtagctgagattacaggcatgcaccaccacacctggctaatttttgtatttttagtagagacagggtttcaccatgttgcccaggctggtctcaaactcctgaccacaggtgatccacccacctcggccccccaaagtgctgggattacaggcatgagccaccgtgcccagctctgttttagacttttaatgtaaatatattgtcttgggaaatgtttcaattagaaattttaaaaatattcaacacatataatgtaccacggttgttatatattttgttgactaaaccagtatcttctttgacatggtgtgcacaggtattcatatatcaattgcaaaagggcttcattcaaagcatacaagaaacaattaaccaggttaattcaataggagttggaaatggattggcttttacaaactatctcgaccagcgccttccagtacaactttttgagatgatggaaatgctctatctctgtattgccaatgcagtagccactagcttcatgtaagtaattgaaatgtagctggtgtgactgaggaattaaatgtttaatttaacttaatttccattaagtagccacacatggccagtgctgtgttgacagcacagatctagaccatcatgtttatttggcagataaggaaatcaggagagaggctgagaagcccaagacagcagtccaatatagcattaatagttttaaccaattttcatgaaggagagattagggaaaagaaggaagacaaataaattgggtacgttagtgttctttttttttttttttttatttttgagccagagttttgctcttgttgcccaggctgaagtgcaatggcatgttcttggctcaccgcaacctccgtctcctgggttcaagtgattctcctgcctcagcctccagagtagctgggattacaggtatgcaccaccatgcctggctaatttttgtatttttagtagagacagggtttctccatgttggtcaggctggtctcgaactcctgacctcaggtgatccacccgcctcagcctcccaaagtgctaggattacaggcatgagccaccgcacccggccgatgggtacgttagtgttctgagactgttcccttatgcaacttttattttaaatcccttgagatgcctagaaaccacccacctggtaggggtgatgtgtaagatgtgtaagattacccaaattgatttcacccctcaaatccactctgattcttacactaatacatttagaaagcacttcatagttttcaaatcttgttcatctatacagttttctcacatttgctcttttcaacatccatgtcaggttggaagagaaaatatcatccctcccctatgtctgaggttccaacaggccaaatgagtagcacaggttcatgtgactagcaagtgcagctgctggggaaggttttgactcttagttcagcctctttctgttacaaccggctgccctttatctaagtccctgagaagtgttaagacttgggaacctgcgttagtattaggggcaaattaggaaagccccacagagcagaagcatcttccacaaaacatcctctggcagaagtctagtgggagtataaactccagaatcaaggagatatgggattggtaacagtctgtcaaacgtactacaagtataatttgggcaagttacttagcctcttttaaatatcattttccttgttggtaaaatgaggataataatggtacctaaaagacttcttgtgcagattaaattaaataattcaagtaaagtgctttgtgcagtagttgttagctataattatgaatattaatatagaaagaattaagttatgttttgattgcttcctgggcctatttctagattcagaatcaggaaacagcaactttggtcttggcatgctttagaatgctgctgagtcttttagccttgtcaccaaattctttccttcctctacaattccctattctctttctcccactaccataccatcaagaaaatggaattgagtttccaccccggaaatctctccattgctgtaaatgttgtggggctctagggaaagagtgaggcacgtgggcttttagaaccattgataggcctcctgatgtccatagcattgtgggaacaacagtataaagccgcatgcccagttcaaaggagtgtattttgaaagttttctaaaattaaaccttttctctctgtgaaaagattttttttttctcacagtcctcctatccttatcactatgaaaattgagccactttctggctatgtcatgctcagggtcaggttccagccccagctgagggctgaggggagtgggtggacatggggcagggagctggaagaacactcgagagacagcaggtagatgagacatggctttattcagcagcagttttcattaacagctttctcacactagctatctcacactgtctgccctgtctcagttgcttagttcagcagctcccaaacacacagctgcaccgacagccctcccttgccttcagggtcagcagcttaactctctctctctgggcacaagtgagctgagctgtgtcctggctccctcctgtctatctacaaagacagacccctctggctctctctctctctttgggtgccagcgcacctgtacagtgtcagcaggacaattataccttttgcaaacaatactggcttagagcaaggcatggccttcccatgttatggctacatggctgtgataacaagtggagttatatgtgtgcactctaaactcacaagtcatgcagaatgcaaacatcttaccttggcctatccttgaacaaaccacagccatgttccttacaggctattattaaaaagtcaaaaaataacagatgctggtgaggttgcagagaaaaaggaacacttatacactattggtgggaatgtaaattagttcagtcattgtggaagacagtgtggcgattcctcagagacctaaaaacagaaataccattccacacagcagttccatgaacaggaatatacccaaaggaatataaaccattctgtcataaagacatgtgcacatgtatcttcactgcagcactgttcacaagaaaagagacatatattcaacctaaatgcccatcaatagtagattggataaagaaaatgtggtacatatacatcatggaatactatgcagctatgaaaaagaacaagatcatgtcctttgcaggaacacggatggagctggaggcctttatccttagcaaactaaagcaggaacagaaaaccaaatactgcatgttctcacttataagtgggagctaaatgatgagaacacatggactcatagaggggaacaatagacattggggcctattggagtgtggagggtgggaggagggaaaggatcatgaaaaataactaacgggcactaggcttaataactgggtgacaaaatagtctgcacaacaaatccccctggtacaaacgtacttctgaacttaaaaataatttttttttaaattgagccattttcaaaatggataggagaaatgagcctgaacataaagcctgtctctaattcagaagttgtatccaataagcttctcttctccttctctagccatcctgtgacctacagctcctccataagctttggaatgttcatgatggatccaagaaatcttggtatcaagggtatcatttggatccatatgttttctccctaatggtcaagccctagtatgagagaaaaacaccaaaattacagaaatcctacacacgaaatagaagaaaattgaagacattattctgagttaaaatagaatgcaaatgataacctgttaccctgtctggtgagacaaaatacacaacactggaaaactgtaaaagtaccatctagggaaataaatctctcctctgtaatttgggtgagcatagctcatcctaaatccattaattaccatccttttaaaagcactccaaatcaatatgttctccccttggagattattcagatgagcagaacggttgtaaaatacttctttggctaatatggatgatgaccagagaaggttgtagtatcattaaggccccaatctcaacagaacataacaaatatttcataattactgtgatgagtgaaatgccatcttctccattctgatcagagattgtatttttgttcttgttaaaaatttgaatcacagcaggagtgtgaatagataacctataaagtgattttagcaatctggaaaaaatattatggttaaagcctggcattgacataactaggaccacagttttcatctccacacaggccaattaaataataggtctacttcacatttataggctgggcccccaactgggaccaggcttttaagcattgtgcatcacaggacataaaacgctggggctacagaatgtttatggttcatactgcctgtcacaattactggaaaaagcaacacgaagaccttggacttatatttgaaggacagtccattattaatatggtgagaaagctctagatctaggtttaagcttttgcggctcaccaactatgtgaccttgagcctgtgaactatggttttgccatgaggaagatagacataataatagcttttcttccgttaccacaaggtaattgtgggaaatacacaaaagaatgaatgagaaatcttgttgtaatggtaaagtgcttagacaagtagaagataatatttatagcttaaatgctgagatttaaaaaaacagttactgttgtgtgtttgttgtgtcttccccctggggtagctttaaaaaacgtggcctgcatttctgttaggatggcatttagacctccacttcatcaaagtcaggaagaaactttcatcagtttttcttccttactgaaatagaaaccccctatgtctccagtggcacgttatcatcacaaaatactgttacgataaatggccatgaagcaaagttgatagccacttcaaaattatccttccacataaattacattaaaaacaacactgtgtaacacctgtaagaaaggctaccttcaagagaagttatttttagttgagagggtggaaaggaaaaagacggcacatgccagtgcctcctgatgagctgtaaaacactcacaaaaaacaggggtgaggccaggcatggtggctcatgcctgtaatcccagcacttggggaggccaagacgggtggatcacctgaggtcaaaagttcgagaccaacctggccaacatggtgaaaccctgtctctactaaaaatacaaaaattaggtgtggtagtgcatgcctataatctcagctactctggaggctgaggcaggataatcgcttgaacctgagaggtggaggttgcagtgagccgagattgtgccactgcactccagcctgggcgacagagtgagactccgtctcaaaaaaccaaaaccaaaacaaaacccaaaaaaccaggggtgagcacattgctttgacttctgttttatacccatcctgaattgtaaatattaaaatcacaaacgcagaaatgctcttaattttcttttatctccttccattaaattaagctttagtttgaaagtcacacaagatctcacatattgcctctaaaaaattgagtggcgtgcacagagaagcacttcagttagagtgacctgggggaggatggcttggggtggggggcggcttcttggatctataccttaaatattggcacttttgaaatcctcaacaatttaaatactgaggggaaaatgccgtatgtagtgagaaataaaggatataaaacacttggaccagtgattgataacagaaaaaggagagaaatctcagtcaactgggacagttagttcaaaaccaggctgggttttgctaagccacaaagactagtcttgcaaagcctttaaatctttgcagggcttctgggtaccgagttggaggatcagcctccaggccataagaagttccactctggggaggagaatcagataagcgaggtcaagtagagagacagctttctactcctctaaggattcatgccaaatatattctcctcgggcctttaaatagaaaaatctctagtttcttcagataaaatgcacagtcactgcataagttgctgatataaggaaaagaacaggagtagtctttttgctgagggaggctgtcctcctttggggaaaccttcgattttgattcatttctcatgagagggagagaacacttacctatttttttttctagattctgtgctcattagctctcttacagctttcactcaaacatgcacttagcccctagaacctgaggaaacataaataaagagaatctcaatatattttatttatttattttgttttttgtttttactttttgagaaggggtcttgctctgttgcccaggctggagtgcggtggcacaatcttggctcactgtaacctccccctcccaggctcaagtgaacctcccacctcagcctcctgagtagctgggactacaggcacatgccaccacacttggctaattcttttgtatttttggtagagacagggtttcgccacattgatcaggctggtctcaaactcctgaggtcaagccatcctcctgcctcggcctctcagatgtaagacacagcaccaggcctgagaatctcaacatattttaaataaggttcttttacttggggtgggtattaaaaatattaatagagaagcacatatgtatatacaaatatatatgcatatgtaggaaaacacatatatgggatgcatgcaaatgtctgctaacaccaaatgccctttaaatgccaggaaactatcacatgaatgaaagaaaagaggtgggaacaagtgttggtttgggctagattttgccttagaaagtcaagaagagactgaatcagattctgcacaaaccatgcctatttaagatgctcaaatatttagaatccaaaataattcagactgggcctacagaaacaaattagtggaattgaaggtgatttattgaaacattctttttctctctatgaaaggcaaataaatctcaggaccgaccctcaaatcactcagccaagggaaaagtgaagctggggtctgtgtcatgcaaacccgcctcccatcttattcctaagtaagatagctacaaagataaaaaagccacatacctccctcacaattggcccacaaggaaattccttgtgagcctcaagctctttatcctaaaaccattctgttgaatttcaccctggcaatgtaaactgataacttatcttcacctccccagacagaaagtcatccctctgaggttcacctgagacatatgcatatctgatggcttcttctgtcctgttgtttaagtaaaaatgcagattcactgagccagactaaattgtgttttcagtgaaaggctgatcaaggactcaaaagaatgcaaccttttgtctcttttgtctagcctgtgtggcctggaaaccactaccccactcttcaaattgtccctcctttctggactgaaccaaagcaatgtacatcttacacatacacatattgattgatgtttcatgtctccctgtcgccctagaatgtacagaagcatgctgcaccccaaccaccgtgggcacatgttgccaggacctcctgaggttgtgtcatgggtatgcccttcgcctttctaaacaaactttctaaactgatcgagacccgtctcagattccagatattttgggttcacatctctgaagctcagttgctatttttcttgtgaactgggcttcattcattaaacacatattcattaactgtttgctaagcaccaggccctgtactcattgctggagctcaacagtcatcaagagatcacagctgctgccccaggaagttgtaatctctccaaggaggtaaatagtatgtaaataaattcataataatgattttagcatagttaagaaattatttcattttaattaatcacctctttaaaggccctaggccgggcacagtggctcacgcctgtaatcccagcacgttgggaggccgaggctgatcaatcacgaggtcaggagatcgagaccatcctgactaacacggtgaaaccccatctctactaaaaatacaaaaaaattagctgggcgtggtggtgggcgcctgtagtcccagctacttgggaggctgaggcaggagaatggcatgaacccaggaggcggagcttgcagtgagccaagatcatgtcactgcactccagcctgggcaacacagcaagactctgtctcaaaaaaaaaaaaattaaaaattaaaataataataataaaaaaaggccctagcttctgatatagtcacattttcaggtactggaggttagagcttcagcatatgaattttgggggaacacagttcaacccataacacttcctgatcctagtacatagttttgatcctgagaggcaatgactgggattcagagaatccatagactactggtttggagggtgagggctaccttccacctgcacctgctcccagagctcagtggtgcaataagcggggcgccataggaagttttaatgttctgcatttcctttctgttgtttcctaatattagacagaaataagagacctgagctttaatcttgctctgaaagagagagataaacatggcatgctacaagaattcgtaagagaaagatattacttgtatttggtgggtcgcagaagctctgcctaagaggtgacattgttgatgggccttggagaatgggcagcaggtggatgtgaagaagttagagcatcagaggcaagacaaaggcgtggatgcaggagcatggcttgtgtatggaggttattccttgtgaatctattgcacatgaggcatttggtatgttataactttgaatttccccagaacctgtgtgagctaagctaaataggaatttacaccgtttattcttttcaacaatgaggatacagaagcttagagaggttgaaaagctcttaagtgacagcgaaaggattgaacacacctgtctgacttcagcgttctacccacagacaggcacttgtgtttcctattgctgcgctaacaagtgatgacaaacttagaggtttaaaacaacacaaatatatgatctcacagttctttaggtcagaagtctgggtgggcgtgattgattttcctgctctgggtctcacaaagccaatcaaggcgttgatagagtgaggccctgtctaaaaaaaagaacaaaaaaaaatcgatacaacaaaatgtatttcatacccaccaggttgacaaaagtgttcaagttggacaataagtgtgggcaaggatgtggaccaatatgaactttcatctgctgctggtaggaaacataaacgggtgtaacacctttggaaaaccatttgcaaagtctgcaacagtacaatggtctactaaagttgacactgtgacccagaaagtccactctaaggttaggaccagctacattgtttgtgggggccactgcaaaatgaagatgcagagtcgcttaaaaaattaagattttggctgggcccagtggctcactcctgtaatcccagcattttgggaggttgaggcaggcagatcacctgaggttaggagttcgagaccagcctggccaacatggtgaaaccccgtgtctactaaaaatacaaaaattagctgggtatggccgggcacggtggctcacgcctgtaatcccagcactttgggaggccaaggcaggcagatcatgaggtcaggagattgagaccatcctggctaacacagtgaaaccccatctctactaaaaaaaaaaaatacaaaaaactagccagacatggtggcgggtgcctgtagtaccagctactcaggaggctgagggaggagaatgacgtgaacctgggaggtggagcttgcagtgagctgagatcgcaccactgcactctagcctgggcgacagagcgagactctgtctcaaaaataaaaattaaaaaaaaaaatagccgggtgtggtggtgggtgcctgtagtcccagctactcaggaggctgaggcaggagaatcacttgaaccctggaggtggaggttgcagtgagccaagattgtgccactgcactccagcctgggcaacagagcgagactctgtcccaaaaaaataaataaataaataaaataaaataaaattaagatttcaagaaagagacagtagagttccaaagcatagggtccttctaagcatggggaacctatatgtctgtacaggtttcatagcatcagctggtcctgcctagatatttaccttagagaaactcttgggtcgtgcagttcagggtccatacaagaatgttcagagcaggactgttggcaataactaacaataggagactccaaacgtgagtgactaaattagtcactggaagactgatcagtgaaaaatgaatgaattagagttgctgacaaccacatgggagcatctgaggagcacaacgctgacccaaagaagaagagtccccaaagaatacacacaacaaagactctatataaagtttaaacaacaacaacaacaacaacaacaacaaccaacagcctgtaatcctagctacttgggaggctgaggcaggaggatcgcttgaacctggaaggcggaggttgcagtgagctgagattgtgctatcgcattccagcctaggcaaaaagaccgagactccatctcaaacaaacaaacaaaaaacaaccctgcaaagctgaatgacatattgtttagagaaacaaaaatatgtagtaaaactattgagaaaacaagacaacgatgaatacgaaaccaaggatggtagtttctctgcagaaacaaagggtctgggatggtcttcagggttatgggcgtgcccttttttacaaacagatccttgggtatttggtttttgttaaattcctgtttttcatacgttatatattgcttaataaatattagttttcatttattaaatatttaataaacttaaaagtaatgcaagttggccctgtttgtggggagaatggtaggaaatggccgggcgcggtggctcacgctgtaatcccaacactttgggaggctgaggcgggcggatcacgaggtcaggagatcgagaccatcctggctaagatggtgaaaccccgtctctactaaaaatactaaaaaaaaaattagctgggcgtggcggcggacgcctgtagtctcagctactccagtggctgaggcaggagaatggcgtgaacccaggaggcggagcttgcagtgagcagagatcgcgccactgcactccagcctgggcgaaagagcgagactccatctcaaaaaaaaaaaaaaaaaaattgtggtaggaaatttccagacctttttgagtttttaaggcttttggatgtacagttgacccttgaacaatgcaggagttaggggtaccaatatccttgcattagaaaatccatatataacttcttttttttttttttgagacagcgttttactctgttgcccaggcttcagtgcagtggtgcaatttttgctcactgcaacctctacctcccaggctcaagccacctcagcctcccaagtagctgggaccacaggcacgtgctaacatgcctggttaatttttgtatttttttgtagagttggggtttcaccgtgttccccaggctggtcttgaactcctgagctcaagcaatccatttgccttggcctcccaaagtgctaggattacaggtgtgagccaccacatctggcccatatataacttatgactgcccactaactattaatagcctgctgctgactggaatccttactggtaacaatcgatcaacacatattttgcatgttatatgcatcttatgctgtattcttacaagaaagtaagctagagaaaagaaaatgttatgaagaaaaacacaaggaagataaaatatattaactatttattaagtgcaagtggctgatgataaagatcttcacccttgtcatcttcacattgagtaggctgaggaggaggaagaggaagaggaggggttggttttgttctctcaggggtggcagaggaggaagaaaatccatgtataagtgaacacccacagccaaacctgtgttgttcaagggttaactgtattttctttttattatgtaatgggggctatttgcacacatctactaagaagcgcaaataaaatgtatttctttattttctataatgatataatcttcctcatcctccctcactcgactgagtggtgatggacagtggaggtgggggcacagtcaagccttttaatcagcccctctgtatctataggttttgatatggtttggctgtgtcaccacccaaatctcctcttgaattgtagttcccataatccccatgcatcatgggagggaccaggtggatataattggatcatggggtggtttcccctgtcctattctcctgataatgagtttgttcttcacaagatctgatgtttttatatgcagcttccctctctgctggtcactcattcttctctctcctgctgccatatgaaaaaggacccgtttccttccccttctgccatgattgtaagtttcctgaggcctccccagccctgcagaactgtgagtcaattaaacctctttcctttgtaaattacccagtctcaggcagttctttatagtaccgtgagaatggactaatacaggtttaaacagtcattttaggaaaatgttcaatctcctttttcttcctctctggatgtagggacctgggagtgcgacatggtggcctcaggggaaaagggctctcgtctagaccttctgactgtcctctggatcttcctggtgtccatgcggggctgctgctctgggctggccccagggcctttggccagtgtccatgaggtaaacgtgagaaacttctttctggttggctcttggctacaacagcccctggtggttttcccctgctaatgcgaccccacaggatcctaggagttctagaaattgctctgagtttagctgcatttctgtcaaatctctgaggcctctttaggagggacgtgtttttctccggccatgactgctcccaggctgggcccgctgctctcagtgcagtggccttcctctccattctggggtgagaaaaaactttccttcatgtcacacaggagctgggggcaacttgggacaggtccccaaaactctctgtgtctaaccaggttctcctgtccctttccctttgctgcagctgaagccgtccctaccaggttgacaagaattgcatgcagggttctggacaggaatataataagtattaatcaggccgctctttggcgcacttcctttttgccgaaaatcatgtggcactagatcctgaccatttgcatcccccattgttctatagatagaatctctgacattagaatcataaggctttggcttaaggatcacttaagatatttttcagacccggaattccagcaaccagtttgacaactcctacagagaaacaggatccacataaggatacagcttcttcatatccctgtcccatgacttcaccctgcgttcttcaaccaatcaatgtgtcaggcctctgagcccaggcctgcacgtatacatccagatggcatgaagtaactgaggaatcacaaaagaagtgaaactggccggttcctgccttaactgatgacattaccttgtgaaattccttctcctggctcatctgggctcagaagctcctccactgagcaccttgtgaccccccacccctgtccgccagagagcaaccccctttgactgtaattttccactacctacccaaatcctgtgaaatggccccaccccatctcccttcactgactctattttcggactccgcccgcctgcacccaggtgaaataaacagccttgttgctcacacaaagcctgtttggtggtctctccacacggacgcatgtgacacaatgatccccacacttcaccccactccaaatccccaaaaagccctaggcccacactccttggggagatgaatgtgaggtttcctcccatctccttgctcagcgaacctgagattacacctctttctctgctgcaacctggagtctcagaatattgacttactgggtacatcaggcaacaaacctgttgtagttctacagttgcccatgtggcctggagccagcccatacaggagacttccccacatggagccctctgtttttggctttccccctccttttttgtgatactgtacaccccttctggatagacaccagaaagggagccgtcatcccaaatgtgtcaaacccttatctcctgaagtggtgtaggaaacactgcctcaaaatatggcaccttggaaattgaaaaagcagaagcaggaaggctatttcacctttttctttttctttctttctttctttctctttctttctttttctttctttttttttctttcaacagggtctagctctgttgtccaggctggagtacaatggtgcaattgtggctcattgcaacctctgcctcccaggctcaagggattctcctgcctcagcctcctgagtagctgggattacaggtgcccaccaccacaagtggctaatttttgtatttttagtagagacatggtttcaccatgttgaccaggctggccttgaactcctggcctcaaatgatccgcccgcctcggcctcccaaagtgctgggattacaggcgtgagccactgcgcccggcctacctcacgttcttcttgcccttcttctctgaagcaagtcataaaacctaggaagttcactgtccgaccttgccctcctcccctgaaaatcctcacgtgacaggtgtcctgccctatgcccagagggaaggaatgtcatgcacaaaggccaagaggaatgtgaacaagcaggctttggtaaatgcccacccccaagttcattacctcaagataatccctgttctccaagtatgcttctgcatgactgtccttgaaaatccacagatgactgtccatgaaaatccacagatctcctgttcctttgggtcttcattttctgaaagttcccgtgtcacataatacctatattaaataaatccgtatgcactctcttgttaatccgatttttgttatttgagtcttagccatgagcctagcattgaatgagaaaagatattacttttttcacctatactttccagtccctgcctcatcctctgggggcagaaggggtgggcccaccatctcttacctgacagtcacttctccttccccatttcctccttctctgtcctgactttcctctggccacaatggcagttgaaaagcagggagagaaagtgcctcagaggaagggaatatctagaaagtttagattccttacattattattttgttgttgttttttagatggggttttgctctcattgcccaggctggagtgcggtggtgcgatcttggctcactgcaacctccacctcctgggttcaagcaattctgctgcctcagcctcctgagtggctgggattataggtgtgtgccaccacgcccagctaatttttgtctttctagtagagatggggtttcacttgttggccaggatggtcacgaactcctgacctgaggtgatccacccgcctcggcctcccaaagtgcagggattacaggagtgagccaccgtgtccagccaatttctttaaaaagataaagaaatagaggtgaggtgatgacaccgcccaccatacccagacctcgcccacattggttctgttgtttccttacactaatttttgaacatttaaggattttaaaagctaatttgtccagggacacttctgccttactttcttgcaagtaagctcatttcaagatgctaataagaaagtatgtttcttcccaggaagtcagtcaaattaagggaggagaccacccctcatattgtcttatgcccaatttctgcctccaaagaaaaagtaaaaactaaaaggcggaaatgaaatccacaggcagacagcccgggccacaccctgggcctggtagttaaatatcaacccctgaccctgacctattcggttatgttatctataaattacagacattgtatagaaaagcactgtgaaaatgcctgtcctcttctgttccgttctaattaccggtgcatgcagcccccagtcatgtaccccctgcttgctcaatcaatcacgaccctctcacacagacccccttagagttgtgagcccttaaaagggacaggaattgctcgctcggggagctcggttgttggagacgtgagtcttgctgaagctcccagccgaataaagcccctccttctttaactcggtgtctgaggggtttcgtctgcggcttgtcctgctacaaaatgtggaaagtgggacaatcacgcccttgtgaaacaacaatcgcagcacttcagccttcctgggtatggtctttgatctttctgcttggctgtgaggggaataaagttgtaatggccgagagctcagaacttagacttgtaaatgaggagctttctgctatgcatggtaagcaggcaagcaatttgaccttcgcttgatgctcagaagccaaaacacattccagacaattcaagagtcaagtgcaaaaaaattaaagtgtaaaacactggacaaatagaattagatatttgtatatttataacatctggagcggtaaagacttagtaaacttagaagtagtagaagtcataaagaaaataatgggccaatttatctgcatgaaattaatttttaaatgaatttactttatcctaactggctgtaagtgaaattggtcacaggcaaattggcttttaaatgaattggtttgagagaaactggccagcacttcctcgggagtggttgtgggaacagagccaagaaagaaatatgtgaggccgggcgcagtggctcatgcctgtaatcccagcactttgggaggccaaggtgggtggatcacctgaggtcaagagttcgagaccagcctgaccaacatggagaaaccggtctctactaaaaatacaaaattagccgggcgtggtggtgggtgcctgtaatcccaactacttgggaggctgaggcaggagaattgcctgaacccagaaggcggaggttgcggtgagccaagatcgtgccattgcactccagcctgggcaacaagagcgaaactccgtctcaaaaaaaaaaaaaaagatataaagaaagaaatatgtgaataagactaactttgttagaggcaaagacaggattggtgactgactagatacagcagggaggcaggatggaaaagtcaagaatgaatgggaggtttatgagcccaggtagctgggagggtagtggaaccaattaacccaagtaggaagcaaagccggaggagcatccttggtcctcggagttgatatcactataggtcacttgttctctaacttttgcctgcatcagaattacatggagagtttgttaaaatgcatattgctgggcgcatccgtagagctgctgattcagttggtctgggttggggcttgaatttgcatttctaaagagttcttaggtggtgctgacgctactgaccctggacctcactttgagaatcatcatctggtttaggggtgaaggtggtggggatagtgtccagcagagagttattattgtgggcctggagccctggagagagatcagggccagatataaggataattgctaccatttcctgtaaagcttcccttcggtgtgccagtaatgagctgatgggcccaaatattgattatgcattagggtgggggctgggcaggggctggagagcccaaagcccccagaccaattgtctttagcctgagcagccacttccatttatcccagaatgcatactggcattatcatttttctaatggaagcagtaatatggaaaactaaaatgttgaaaagcactgactgagcacttactctgtggcaggctgaagtgatattcctatgagcaagatccaattattatccagatttaagagaagagaaaatggaggtttagagaggttaagccactcgttcattgtcacatggctagtaattggcagatccaggattaaaactctgtctggcccatttccagaccttgagcttctaatcattgtgcctcttaaaggatttgaacattacctgcatagaggtgatatttaaaacaatgagattggatgagactatcaagcaagagggcatacagagaaatgtccaagtacagtaccttggggaacatttaatctaggggatgaggggaagaaatggagtcccagaggatgttacggaaatgaaaggagaagaaagcatgaagaaagtaaaagaatttcattagtatcatatgccttggagctgtcaagaaagaaaaacaaacaaaaaagattactaaattttgagaccaggattactgttcttgaaaggaactgcttcatcagagaggtaaggatgaaaagtgaatgtttagtgacctagtggtgcttagcaaacaaccccagaaatagcaacttaaaatagtagcgtcatttgccgggcacagtggctcacgcctgtaatcccagcagtttgggaggccaaggtgggaggatcacaaggtcaggagtttgagaccagcctggccaacatagtgaaaacccacctctactaaaaatacaaaaattagcctagcatggtggcatgcgcctgtagtcccagctactcgggaggctggggcaggagaattgcttgaacctgggaggcggaggttgtggtgagccgagattgtgccactgaactccagcctgggcgacagagcgagactccatctcaaaaaaaaaagtagtagcatcatttattgtttctcacatttccaagcattgactaggctctaggcttagctgggtgatccttcagctccaaatggtgttggctggggcgctgggaggctgcagtcatctggaggcttgattgcacagaaacatcccaaatagctgattcacctgactggctgtcagtgctggctgttggctgagaacccagctggggctgttggccagagagcctcagttatcccctgcacacagtttatgcatgaggttgagtttctcacagcatggtggtgggattccagcaagatctgttccaagttcataaaagtcaaagcagttgatctctatttttttgagacagagtctcgctctatcgcccaggctggagtgcagtggcgcgatctcggctcactgcaaactccgcctcccgggttcaagcgattctcctgcctcagcctccagagtagctgggactacaggcacccgccaccgcgcccggctaatttttttttgtatttttagtagagacgaggtttcaccgtgtcagccaggatggtctcgatctcctgacctcgtgacccacccgccttggcctcctaaagtgctgggattacaggtgtgaaccacctcgcccggccataaagcagttgatctcttaagtctgtctctgatgttacatagtattgtttcaaccgcactctgttagtaaaaggaagccacaaggtcaacccagtggaggagtagactccacttctcaatgggaggagccaaaaatttgagtctattgaaaattcatcacaggatagatgataataatgtggatgtagctaatatagattcttttcctttcagtaaatattatataggctgtatgcagtggctcacacctttaatcccagcactttgggaggccaaggcaggtggatcacctaaggtcaggagttcgagaccagcctggccaacatgctgaaaccccatctctactaaaaatacaaaaatttagctgggcatggtggcgtgcagctgtagtcccagccactctggaggctgaggcaggagaatcgcttgaacccgggggtggaggttgcagtgagctgagattgtgcctctgcactccaacctgggagattctgtcgaaaaaaagaaaagaaaagaaaagaaatattataacaaagggaaaaaaagaacaatggatgttggagagcacagttttggggaaagattgttttaggtatacaggtgaattagctgcgtgtggctatataacagtataggtaacatcccgttacctttgccatattctaattgttagaagcaaatcacaggtcctacctgtgaggggacgtacatggtcaggaacaccaggaggcaggaattatggggccatcttagagtctgcctaccacagaaggctgaaagttgataatagtctggaaggcaatggcgagagtagaaagaaaaccaatctcaagagagaggtcggggacaattggtagacaggggttaaggttacctgtaagttagatttggaaaggggaacttttttgttttcaacatataggaaaagggagagaataggagaagatgagagaagttttgaagtacaaagaagggaaatttctaggaaagctcacatcaatgaacctccatcttccccataaagtaggagatgggattatttgctgagtctgagagttaaggagggattcatgctttgaggaaaatggaaaatatttgaaacagatgctatgggaaatgccatagatggtgattaaagtgaaaataaggagagaaaaggataattaacagcagacagagtcagcttaagttgtttcacatgaatcgttttagaactgctggccaacaattttagatatgggctgatgatgggatttaagctacgtaagaaggcaaatgaggtcaagaataagcaaacgtggtaagaacagagcttaaagagaagatttccatgagggcagattgtagcctcaataaggctgagggaatagtaaaggggattttaaaaattcttaatcttacttgaatttccagcaaaatgtgttaccctgtcttgttgaaatgctctcctccttgcttcatagcctgtgcgctttgtgtttttcctgcttctctggaatcttggtcttgttctgcctctctagttcctctgttcatcctccagctaaaggtgaccatcagggttctcccctaggactgcttcagggtgatttcctccactcccacggatttaattactctctaaaggctgccaaattgccaaagttatgtttctagtccagatttcctcattaatttcagtctatgcccagctgtctgcatgacccacaggcattaaagctggacatttcaaaaaatagaaagcactatttctccccaccaccctctcccctcttcttccagcaattctctatctcagggaagggcaccaccatctacttatttgctcagctgggaaactccatgtcatccttgatgccaactttccctcaccccatccctatctctatactactctaccactttctttccccttctctatggccattcttctactctctcttccatcatactttgccagatcactctatcagactcttacactgccttgctacttctaatactgattcctacaacctattttcctccctgtagccaaagggatcttgcaacctgcaaatcttattatgtcaacacacctccccactcaccctctcaccctgacacatggacacacaccatttaaaatctgtcctattgcccataggataagtaataaagaacaagcatttgctgagaactttactttgtgccaggcactataatttactttttatttttatttttttttgaaacagagtcttgctctgttgcccaggctggagagcagtggcatgatctcagctcactgcaacctctgcctcccgggttcaagtgattctcctgcctcagcctcctgagtagctgctgttacaggtgcatgccaccaagcccggctaatttttgtatgtaatttacattttagaagtacaaatccatcagcatgctatttcaggatgctcattatctggtcctagtctaactcttcagcctatccttatctattccttcctttttacctggctccttccaaatcacccttgaagaatcagcttaaggttattattgcttccggggagcctcccctatcctaggttcagcctctcttagggaacatgaacccatcacagtctacagtattaaccttctcatttgtctgtctccaacacaactctgtcttattagtttctacacttgcactgtctttcacagtgcccagttcatagtagatgctcaataaatatttgccgaatgaatgagtgaatcttgaaggtaaaacaattccacatatggatagagttcaaaggagtggctctacctgtgtgtggctccacacctctccctagctttttctatgttgacaaccttttttacatgtttaaaaaatagatgtctaaggcggggcacggtggcccacacctgtaattctagcactttgggaggttgaagcaggcagatcacttgagctcaggagttcaagatcagcctgagcaacatggtaaaaccctgcctccactgaaaatacaaaaattagccaggcatggtggtatgggcctgtagtcccagctacctatggggctgaagcaggagcatcacttgaacccgggaggttgaggctgcagtaagccgagatggcaccactgcactctagcctgggtgacaaaagtgagaccccgtctcaaaataaataaataaataaaaataataaaattaaataaaaaagaaaaaagaagtgtaatatttaattttaagttacattgtgaggttacataatcccctactgttaaccacaaatctttagcagggcccacaatagaacagaaatttaaaggaatagtgtttgggaggaaatatatgttcaacagccatatgccccacttggtgattggaccatgcaagtcaagggttaaattcaacaagcaaggaataagacagatttttttgagacggagtctcgccctgtcacccaggctggagtgaaatggcgcaatgtcagctcactgcaacctccacctcccaggttcaagtgattctcctgcctcagcctcccaagtagctgggatttttgtgtttttagtagagacagggtttcaccatgttgctcaggctggtctcaaactcctgacctcgtgatccgcccgcctcagcctcccaaaatgctgggattacaggcatgagccactgcacctggcctgagagatttagaattgaggagaagagaacatagtagctagaggtgactaggcaaaaacataagcccgtgaagtccctggacacactgggaaggtcggaggatttcccataataaatgagctggggatttgaaccaattttatttgaatctcaatgcacaaagtgaccccagtagatatggagttaagaaagtcaaatgcatgtctgtaattatttttatcagtatattcttctttttaaaaacccagatatcaagaatcagtccagatcattatattcttatccaagcctttctgcattgtttttagctacatggaagggacgggatgggaggattagcataacatttgggtaagggcaatatattttttaaaataatcaaacagaactgtggatgagataattttaagtctttacagaagagctcaaaggaaagaataccttatccttgacagaatgtaaaatttggttctgtagaatgtagaatgcatgggtttttttttttttttttttttgagatggggtctcactctgttgcccaggctgaagtacagtggcacaatcacagctcactgcagcctcgacctccctgggctcaggtgatccttccacctcagcctcccgagtagctgggactacaggtgcgtgccaccatacctactaatttttctattttttggtagagacgtggtttcgccatattgcccaggttaatctcaaactcctgggctcaagtgatcctcctgcctcagcctccccaagtgcttgggattacaggcatgagccaccacacctggcctgttttttttttttttaatcagttagtaataaatatgtgcctttcctcacttctctactttctaactccatttctgttattttagatgcagtgttcctgggctccccccctcttttttttttttttattgagacgagtctcgctctgtcgcccaggctggagtgccgtggcgcgatctcggctcactgcaagctccgcctcccgggttcatgccattctcctgcctcagcctcctgagtagctgggactacaggcgcccgccaccacgcccggctaatttttttgtatttttagtagagacggggtttcagcgtgttaaccaggatggtctcgatctcctgatctcgtgatccgccagcctcggcctcccaaagtgctgggattacaggtgtgagccaccgtgcccggcctcctgggcacttttgacactcactgcgtgggctcacaccccattagactgagatggaagggagggtttaggaggaggtgtccagatcagggaaagaagacctgtgtgaccccgcctggaggtcacagcataagacatgaatgaatgagagcactggttctcaaagtgaggtcctcaggtaagcaaatcctcatcacctgggatgatgcttgtgagaaatgtgaatttggggtcccaactcagatctactaagttcagggtaaggcactgcaatcagtgttttcacaagcccttcaggtgagcctgacacatatcaaagtttaaaaacctcagtgggctgggtttttgcatgagtactttagtaaccacaggcaatacatacttagattatttttctactcttttctgccaaaatgatttctactactgagatagtcttagaagttacatttttaaagtaatcatgaagaaaaaacatatcttgagaacactgagaaaacataacagccactaactaggctctatggtcaatgcaatttggtcaacgccattccagagagtactcgaaacagggcaggagagcctcctacctctttgacttccccattcaccatcccacgtctcaagtttctgtcattatttttctagaaaagctataaaaatcatcccacttcctttttgcattcaccacaatcactcgcatgaacttcagttcactttttaattttattttttgctaggcttcctgaaatcatgagatcagttcacttttaagtgtctgggtttctgctgagctgcagagcagcctttctcctagcatttctgccctgccatgtttatcttccctgttgagattgggtaagaggaggtggacaaaaagtggtgacagttactttcactctaagggaaactaggaggcatgagttcaacaaatagtaatcatgatcattttgcgtgcgatgcaatgtgagaggaaggaatacagataaatacataagatgcgatataaatggtatgataagggtgtgtataaaatacagagaacatagataaggagcaattgatggaatggtggagaaatggattaggagaggtacaaaaaggaagtaacattggcaccggtccttaaggtcaagttcaataggtagatggacatgggaaggggatgtcgggtgaaggggacaccatgagcacaggcttgcagataggaaagatgtttggggcttatttcaccgtagttcagtgtggctggaatataggggacagagcaagagcagatgcaaaaggaagtggcccacactctaggatcacctgtgagggccccttcctgcactcttaaatattttggcatactcaccgtttggatgaccacatggagtacagtttcagttgagcagtgggatcagaatcaaagttttatctattctatctatctgtctgtctgtctgtctgtctatctatccaactatctaatttttaaagatagggtctggctctgtcacgcaggcttgagtgcagtggtatgatcctggctcattgcagcctcaaactccttgactcaagagatcttcctgtctcatcctcctgagtatctaggattacaagtgcctgccagcacacctagctaatttttaaaaagttttttgtaaagatggggctcaccatgttgcccaggctggtctcaaactcctggcctcaagtggtcctctagccttggcctcttaaagtcctgggattagaggtgtgagctgccatggctggccaaaattttggtgtatagattaggagatggactgtaaagaagggtggtcatttgaataaatgattcacaggagaaaacgggttttactgtaacaaccaaagcctaccaatattgagtttccttattcattatgcatgttattagggtatttttagctccagcattatgattttgcaagtaaaataaacttggggtgaacgttgatgcggccctaagtatcttacttcactgaattggaattctactcagattagtcttagtagatctttctttcttccctgctaatatccgggaagcaaagaaaaagagatttcttgaagtataacctattagaacttgcatagaggcatggcgagcaaaggttttatagaaatacctgcagatgtttggagctgtaagaacacagtgcttgaggatgctgaccctgtggtgggatataacgttgagtgccttttcccagacccaatatcattaaatcctgcatagacggggaacccagaaaccatcatctctccatgctccagagccctgcagagacaactgaggtttctggatgagtttatttctaaatacaatagggaagaggttattcacacagagattgtcaccaatatgattataggtccccaattttttattatacatggcaatagaccagacactctgaagatcttattatttccaacttgatgtttaggatagcatggcagattgtattttccaaagatacctacggtaatatctccgaaaccatgtggtcttctgcaatgggaccttgtcacgtctcccttgaatgtgagcaggatctgtgactcctttaacaaacacaacatggtggaaatgatgctgtgccatctggcctggaagcttcctgcctcttggttccctctgacaagccagttgccactttggtgagaggccccagtcacattgagaggctatgtgtggttgccctggtcaacacccaactgccagcatcaactgccagctatgtagcgagctctcttggacatctagcccagtcaaagccttgggtgactgtcaccccagccagcatctgacggcaacttcagagagaacccagatgagaactgctcagctgaaccccatcatccaaaaaactgtgagaaatagcagtgagttgttgtttgaagccatgaagtattttgagctgtaatccatacactataaaatttatctttttcaggtgtacaatatacagagctataaccatcaccattctcagttaaagaacattcttgaccagtcgccgtggctcacgcctgtaattccaacactttgggaggccgaggcgggtggatcacgaggtcaagagattaagaccattctggccaacatggtgaaaccccgtctctactaaaaatataaatgttagccgagtgtggtggtgggcacctgtagtcccagctactcggcaagatgagacaggagaatcacttgaacctggaaggcagaggtggcagtgagctgagattgcaccactgcactccagcctggtgacagagcaagactctgtctcaaaaaaaaaaaaaaaaaaagaacatttttatcacttcccaaaaatgaaaccccctggccagcagcagtcaccccccacctacccaccccctagtctctggaaaggactaatctacgatgcccctgagggtttgcctattctggacactttactgtttgttttgttttgtttttgagaaagagtcttgctctgtcacccaggctggagtggagtgtcatgatcttggctcactgcaacctctgcctcctgggctcaactgattctcttgcctcagctttccaagtagctgggattacagacatgccccaccacacccggctaatttttgtatttttagtgcagacatggtctcaccatgttggcgaagctggtctcaaactcccgacctcaagtggtctgcctgcctcagccttccaaagtgctgggaacacaggcgtgagctactgcacctggctgaattcttcttatgtcacagcctacagacaggttaatgaccagtttcttcttggcccaccaccatccatcgtgtggtctcccaggcaccttctcatcccagaaaaatcccatctcccacttatatggttcacatataaattcctccaccaatcctaatctgagtctttgatttcagttctgggtaaatttcatgtgtactttaatctcggcccctttacatggcttgttgatttatgcggcttcttgaaatgctgtttacaaagttagacccttgaaaagtggcataattggtttgcatgtgaaaactaaatcaagattcacctcaaacccaacaaaataaatgaagacagaatgaagcttttgcctggcatttagcagggctggcacagatttttcctctatagcacatggaagagcaagtgaacagcattccctgaagtctcaccaggagctctaagctccagagtgaagccaaatcaggctgctaacccgacggagaaaacttggtgtgaatatacatatatatgtcacatatctgtgtgagcatataatatgtatctatatatagtcagctaaagctggcaatgaaaacaaaaactctactttcttggcttactcaaactgcataaaaatagtgtttaacaatcaaggaagaatgtgcaagccactgctggttaaaggatgtgtggctatcccatgaaagaacctattaagaatcctacaggcttactgctggcttggtttggaagccagaggccagctctctgtcatgttctgtgctaattcaacaggaatgacttcaaggagggttttatgttcaggcatgatttatgtggcagggaagaataaagggattcctgtaagctagcccaagttaggggatctctttgagtgattagtccaataaatacgtagatgctggtgaggctggggtgaggagtctggggagaacaaatgcacacaaaatgcgtgtgcacactcacgtgacgtgtgttaaatgtatatgcagatatacaagcactgccagccattgtatgggtttttgagaatccatggagtttgaggcactggataaaaatttctagtgattataagtttaaattacaattttaaaatttaaaaatttttttaaatctattttttatttttttgagacaaagtctggctctatcgcccaggccagagtgcagtggcacgatctcagctcactgcaacctctgcctcctgggctcaagcgatctttcccccttagcctctagagaagctgggaccacaggcgtgtaccaccacacccacctaatttttgtattttttttggtagagacagggtttcaccatgttgcccaccctagtcttgaactcctgagctctagccatccacctgccttggcctcccaacatgctgagattacaggaggaagccactgtgcccggcaatgtaagttatattataattttaaaataacttcatctaatattatttgacatctatatattcaaatatagacaaacatatatgacaaacatatttatttgacaaacatatatgaagcatctgtcatgtgccaggcaccatggttggcagtaggtatacaaagatgaataaagcagacttcctgcctttggggagcttgcaatccattgagcaggacaaataaaattattctgcaatgtaatcaagggctataatgttggcataaaccaagtctttttttttttttttttgatacagggtcttgctccgttgctgaggctgcagtgcagtggcatgatctcagctcactgtaacctctgtctctgggttcaagtgattcttgtgcctcagcctcccaagtagctggaattacaggcgtaagccactgtgctcggcctaaacaaagtcttttggaatcatagaaaattgttccagttactttcactgtgtaacatattagcccaagactaactggcataaagcaattattttattattctcctagacttggtgggttaggaatttggagagggcacagaagagacagagaagagatgacttttttctgtttcatgatgtctgggaccccaactgggaagacacaatgagcagaactgctgagtggagtgtgtgcacatgactccccacagagccaggcttcctcacagcatggcagcctcaggctccaaatgcgtgtatcccagcaaataaggcgaaagccacatcacttcttatgactcagcctcataaaacactaggatcacttttgcaatactctattgcgtgaagcagcctcaagcccacccaggtgcaaggggaaggggcatagaatctaactttcaatggggtgactgtaaaataagtttgtggccatttaaaaaactgctatgaaaagacagtgccttagtaatttggggaatcgggaagtcttcactgaagaggtgatgtttgggatgcatcttgaaagagggacaaaagtttgccaggagaagtggggtgaaaagagaaatgattcttcatagggaatggcaccttttaggcttacatgtacacaggaaatactgaaatacaagaaggagtacaaggggataactaggaagtggatcaagcatcaaaggaaaaccagtctcatagctcccagacaccttgaatacatcagcatgtttgaactgctaactcaactcaataattgtccattgattcttaagccatatatagggtttgggaaagaaccaaaccatagttatttatttggaaaagaactgtggagcagataggttaaagttggaatttaaagtggaaggactactttctctttaacaaacacataatacctattcttcaggtatcatactaaggacatgacaatttcaactcacttaatcctcatcacagccctaaaaggtagctattgttattctctctcaattacggattaaaaacttgaatcccaaagaggttaagtaacttgcccaagggcacgcagtggatcagtggcacacccaggattcaaatgcaggttgtcaggctcagcctgcgcacctcgccactgtgccaggtcaccctcagacaactagagagaacagtggctgaaattaaaggcaacatggggagcttgactttgatccgtatgacaattgagagccatttagggcgtctgaaatggcagtacgtgtaatgtaaattgtgttaacctaactagttattggctgagccagacaggaaaacaagtctctagctttttagttcaacattcttcactattctataacgctgtgcttggagatagtattttatggttcagtgccactactgagactcttcttaaatgatgaattaagaggctggactcttgaagaagcaagcaagggaggtaactcacgctctgccattttatctgcagggtacttccgaggtgaggccaaattagttgacttatccacgtagttgttttaaggctaatctaggacaatgcaaaacatacctctgtagtttgactctcagtgatgaagcacagtatgtaattagaagcagtttcatttgtccatccattcagtactgttttttttactgccatgggctgtgactgacctaatattttgctgcatggtatagtgccttttatatatacatgctgacgtcaggcaggacagcattaatggaggcaatatgtctaaatgaaaacaccattacattatcaaagtgaaaaatggctagatcagcaaatggagtattagggatggaagctgagaaaaagaatattaaccttgcattcaattttagtctcatatctgtgacttccttgtgtagttattatagaaccttaagatacatgatggttgaaggacagttgggggcacactataatagctacctcataaaaatggtaggagcaattggcagcttaattttggggtttgtggaagtaattttaaatggaatttgtgttaatcattttccataaatttagacatttcactttgtgatgactttacactttcactaagatacagtagaaagtgatgggaataatggaaacaatgaaaaccatgacgtcaagccctggtctcagaaatgtccaccaagcagacgtggaaacagacgaatgcattaatttttgatcatcttgaacattgaaggtggtttaaaagagcaaaacaatagttctagaatttgtatatagggtatataaagacataacacgggagaaaaatcaagctgattttggcagaggtgtgcaatcacttgggccagaacaaagtcctgagcacttaatcttataaacgatctctggtgagctttagtggacatacgagataaatagatagagatagagatagagatagagatagagatagagatagagatagagatagagatagagatagagatagatagagatgagatataggtagacattggtgagttttctaaaaagcgggtaatcattaagtaaacaactcttaaaattatacttccagctgagcacagtggctcatgcctgtaatctcagcactttgggaggctgaggccagcagatcgtttgaggtcaggaatatgaggccagcatggccaacatggtgaaaccctgtctctactaaaaatacaaaaattagccacgcgtggtgggaggcgcctgtaatcccagctactcaggaggctgaggcaggagaatcgcttgaacccaggaggtagaggttacagtgaagacagttggcaccactgcactccaacctgggtgacggagcgagactttgtctcaaaaaaaaatgtttcctgcatgtatgtatgtatgtcacacaaacttctttttctccaataaaatgatgcacatgccccctacgttgactctccatctgcctccagctggcagcaggaatggagaaatcaaagtaaccaatactggtttgtcaatcagaccaatgaccagcgcaggggcctcctttttttctttcttaagcctgtgtgtgtgtgtggggtgtgtgtgtggggggggtgtgtgtgtctttgcggacgtgcagagtaaaacagagcagacaatatgcatctgtatgctacatgccttctctacagacttcacacacactgtccttatctcttggataagttaatgagactgttcactgatttctaagttataatttcaaagaggcagtggtgggaaaattgatctacaagtattttttttttaattatactttaagttttagggtacatgtgcacattgtgcaggttagttacatatgtatacatgtgccatgctggtgcactgcacccactaactcgtcatctagcattaggtatatctcccagtgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgggcaacaaaagacaaaattgacaaatgggatctaattaaattaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaaacaaacaaccccatcaaaaagtgggcattgggaggccgagacgggcggatcacgaggtcaggagatcgagaccatcctggctaacacggtgaaaccccgtctctactaaaaatacaaaaattagccgggcatggtggcgcgcgcctgtagtcccagctacacgggaggctgaggcaggagaatggcgtgaacccgggaggcggagcttgcagtgagtcgagatcgcgccactgcactccagcctgggcgacagagcgaaactccgtctcaaaaaaaaaaaaaaaaaaagtgggcaaaggacatgaatagacgcttctcaaaagaagacatttatgcagccaaaaaacacatgaaaaaatgctcatcatcactggccatcagaaaaatgatctacaagtattaaagggctttgggtgttggggcattagggtgacacaaatacattacatattctcctctagactagaatcttttaagtacttatttgggtctattacagacactcatttctctttagaaatctatctatcctgctgacaaagctagtggaatatcaaaagttctacttggatgggcccaaaacatacataaagaggaatattaagcattcctttttatttgtaagttatgctaataaccaatggttgaagaaaggcgtgtcatatggccagtgcatttaaattatcgctatttcccagtgtttactctccaagtttttgatacacattaaaccttggctactacatggtcattccatgctagattatacgttggatgtttggaaaaacgttattattcaataggttgagtttcgggaaggagtttgttttaccttccagagcgaattgcttataagaaaaagaggctatttttggattcttttttattctattaatgtcagcgctattgaaactctttgatttttttaccctgttgcttagaaacattttattaaatgttgtcagtgcttctatctgatctgatttaaaatgttacttttatctgccactgtagaatgagctctaagttattaataggtattaaaaatattttattgacaggagaatgatatatcagattaagccagtatctctggcttatctattttaagggcattgggtggggtttgatttggtgaggtttgtgatgggcaaaaacaggaatgataggatatttctaacattcttggcctctcactcttagaacctaagggtagatagattgggagggataagggctcaaatctcctttctcaaattagctccaatcacctgtcctgagtccaattgcccatcaccatctgcctgaaattccaccatcagagacattactttgatcttgcttaataagttatcagattcagagttaactggagatttgctgaacagctggataagcatgagacccagaagaaatggggtacaggatagggagttgctgaaaatagagggattaggaatcggggggtgggtgggaataaaaggaaaatgaaaaactgacaaagccaaggataacccatttcacctcctcctctccctgctgtccgcaggtctggtcctcaggctgtgagtgatgtgccttaggggcaggaggaaagtcaagtcctcctgggccttggatgactcccttgcaagaatacattctgtgagttgagaccagaagcagcaaccagaataactagatgattactcttctcttcatgtggtcaaagtatttatagtatttgcttaataaaactcatgaaatctctgagattgactcaattgtatgattttcgctggcactcttgcgtgtgcacacacacacatacattttaaatttggcctgattttcacaaagacctacttcataacaaagggctaattgggccactaattcatgttaaacctgaactggggaaacactaaatgctgttttaaaagtaccacccaactcataccctctaaataacgaaggactttttgttattatagctattcttcaaattaatacagttatattacatccactaatagaaatgattttaggtggcttaggatagttacaataggccatgaagattgtatcaaaccaagtgaaataaaacttcccaagtggtcactccaattccacacacacacttcatatttatgtagcgatccccttgtgctccctgttagataaagggcatcattatcactatcaacttgactattctgattctaacattttatgtaatatgaaattctcaccactgcagaatctcttattctgctgggtgattggctttaacgttaaagctctaaaataacagacagtagtagttattacaataccagtgttttttataatagaaagcatgttcatgtaacatacacggtaggtcaggtttccttaaagtctcaagtttcacacagaaactgacaatgcttaggaaaggaaactgcatttaggagaggatttccaactagaagctgctaatagaggcactaactaggcaggaagtattcaaattggttataatttaattatgtcaatatcccttctaaaaacaaataggtcttagccatgattcaggcagcaaaaactaataataacttggtgaggaattactatttttgcccacatgtatctgggtagttgaagcaatctgattgtatgatttggcacgagtccagtctatggtctaaaatagctacatgggaaaatattggaagtgtattttagcctctgaaagatttaaacctggtgaatcagtatgtttctcccctgatatttgatgttcatatgtcactggaaagcaaacacacaaagacacaaacaaatgaagcaggtttcccagcattttatattaacgaccaccatcaagtttgacgttttatacctctaatattctggggagctcatgatgtttgatggttgtatttgctcactgatccttaagacagatattcttgagacgtatgaggtaatggcaagatgctatttccagacaaaagatgggccatctaagtgggaagctattcacaaataataaatctgtagataggtgagatttaaacacctaagtctccctgtaaaatgttgctttttttttgttgagacagagtctggctctgtcacccaggctagaaagcagtggtgcgctctcgactcactgcaagctctgcttcctgggctcaagcgatccccccagctcagcctcctgagtagctgggaccacaggtgcatgccaccacacctgactaatttttgtatttttttgtagagacagggtttccccatgttgcctaggctagcctcaaactcctgagctcaagcaatctgcttgcctcggcctcccaaaatgctgggattacaggtgtgagccaccatgtctggccaaatgttgttttgtgtatggaaaactcttaaattttagatttcatgaatagtcaaaataggcagcagcatctactcttagtttcctttttttcccctgttgtttgaactgagttgcccatgtgtgtacccttagacttagcagtctgaaaaattatcctttgacagctctagtaaggcttatgtagtctgacatactgaagatggatggaggtttcaaatttggagggacttctagaatttctttttctctccaacagtaactgaaacagtcaaaatgctggatcagagaaaagggacaacacacacacacacacacacctcacacttttcatagacccaaggttctatggttacagaaaccatgaaccgatttcagggatgacaatggaatccgaaatgctttggatttgagaattcaagtcttttcaagagcacggtggaaagtcagtgaaatgttataaatactccaagtagcagaagtgttaccgtataaggagatgccattatttactaaactctctctatgctattatttattaaatactgtctttccgtgttaaaacaagtaaggctcaatggacgtttgggctttgatggtttcattgtgatctgtgtccattcaaacatcaaagagttttggagatatgagtgcaaatccaatcagacacaaaacccactgcctatttctttcacttatctagccaaaatttatttacagtgagctaatattaatcgtgatactgaggatgcatagatgctcaaggtccatctcttatcttcatagatgcacaagcatgaagggcagcagatttgtgaacagatacaatatgctaactgcagccccagagatattcaaaggagagacaccaactcacataggacagaagggaaggattccagagaggtgatccagaatgaataggaattagccagaaatttgtaaggggaggttggaaaagaaaggggggaagaaaggtattgcaaatggagggattcctctgagcaaagacacagagggaagaagcacaagagtatttgagctgtctgttgttcttgaagcaaaacaaaacaaaacaaaacaaaacaaaacaaacaaacaaaaaacctagagataaggagtggaaaacttatggctggggcaagagagatatgactagagagactgagataaggatagggaaggaggtgagcaggtgacaggttctccagagcattgtatggctggccaagtaaggagagtttcaagtagagggcaaacatggcagattagctgacttggatgagattatacacagggaagtaagagaagatgaaggatgaagatgggaaacagtaatagcaatagaatgagggggctgagtttagcaatatgtagaaggtgtgcagttggccctgatgccagcgcttgccttctaggaatgaagagattggctatgatccatatattctagttcatttgcatatatcatcttttattgaattttctggcaggataattcttcaggtgaggctggtgttttagccaatcagaattattatccatagcttctagttcatttgcatatatcatcttttattgaattttctggcaggataattcttcaggtgaggctggtgtttttgccactcagaattattagaggcaagtaaaagaaatgaactctgtataatttaatcagagaaagagttcttaaaggatattgagtagttcacagagtttctaaggatggcacatggtttaataaagacacttgcagtgatttgactttatttatttatttacttttgagacagagtcttgctctgtcgcccaggctggagtgcagtggcacaatcttggctcactgcaagctccgcctcccgggttcacgccattctcctgcctcagcctcccgagtagctgggactacaggcgcccaccaccacaccctgataattttttgtatttttagtagagacggggtttcactgtgttagctaggatcatctcaatctcctgacctcgtgatccacctgcctcggcctcccaaagtgctgggattacaggtgtgagccaccgcgcccggccccctctttcattgtttatgtcagtaatttgtgtcttctctctccttcttgttaaagaatcagtgtttgatttacttcattttctctatttttctgatttcaatttcattgatttctgctctaaactttttaaaaaattttatttacttattttttgagatagagtctcactctgtagcccaagctggagtgcagtggcatgatcttggctcagtgcaacctccgctcctgggactcaaacgattcttgtgcctcagcctcctaagtagcggggactacaggagcgtaccaccatgcccggccaattttttgtattttagtagagacagggtttcatcatgttgcccagggtggtctcgaactcctaagctcagttgatccgcccacctcagcctcccaaagtgctgggattacaggtgtgagccaccatacccaggtaaactttattatttctttccttccgcttgctttatttttgcttttctttttctagtttatttaggtgtattactccattttggagaccaaataaccataataccaaatcctgactaaaatagcacacacaaatttaaaaaagaaaaaaaaaaaacaaaaactgatgaatctataggtgtaaaacttacaaataaaacattttattaaaaataatcacataaatagttaataaggcacttttacttctatgggataaacttttttttagcttccacatatgagtgagaacatgcagagtttaattttctgttcctggcttatttcacgtaacataatgtcccccagttccatccatattgccataaatgacaggacttaattctttttatggctgaatagtactccgctgagtatattcaccacattttctctatctatacatctgttgttgaatacctaggttgattccatttcttgactattgtgaacagtgttacaataaacattgggaggcagttgtctcttccatatactgatttccttttttggataaatgtccagtagtgggattgctgggtcatatggtagttgtatttgtagttttttgaggaacctccacactgttctccatagtggttgtactatgtatgagtttacatttccacttacagtatataaaattcccttttctctacatcttcgccagcatctgttattttttatcttttttataatagccatactaactggaatgagatgatacttcattgtggttttgatttgcatttccttgacgattattgatgccgagcactttcatatatttctttgccttatgtgtatcttcttttgagaaatgtctgttcagatcatttgctcattgttaaattggattgttttttgctgttgagatgtttgagttcctcatacattctggatgtgaatcccccattggatgagtagtttgcaaatattttctcccattctgtaggttgtctattcactctgtcgattgtttccttggctatatggaaacattttagtttcatatactcccatttgtttattgttgcttttgttgttagtgcctttgaggtcttattcataaaatcctttctcaaaccaatgttctgaagcatttcccttatgttttcttttagtagttttatagtctttcgtcttacagttaggtttagatgcattttcggttaatttttgtatagggcaagaggtgggggtctaggtttattcttttgagtatgactatccagttttcccagcatcatttactgaagagggtgtcctttccccaatgattgttctcggcacctttgtcaaaaatcagttggctgcagatatgtaggttaatttctgggttctctattctgttccattggtctatgtgtttgtgtttattccagtaacatgctgttttggttactacagctttatggtatattttgaggcgtgctaatgtgatacctgcaactttgttcttttccctcaggatttcttggctctatcttttgtaattccacagagattttaggattgtttttcctatttctgtaaagaatgtcattggtattttgataggcattgtgacagttttgaaaaatagattatagcagatatgatgctatgtgacttccaggctaggtcacttgctctcagagctctgagtcaccacgtacaaggtccagcttccccccagttttgcacagagacaataaggagaaggcctgtgattacagatagaaagaaatgttcagtgagtttctcgttgtttgagtcatcccagcccagccccagacatatgaagtctccagatgactctaatacccagacattagagtcacctctagacattttagaatttcatccaaggagccagctattatgaaacaagtcatccttactgtgttttgtccaaattcctgtcccacagaatctgtgagtataaggaaggtttgttgtgcagcaatagataaccagaacaacacacagactcagtggctgcatatacaacctgcaacttgtaccgccatcatcacatatgccagcatggatggcagagtctctgtcactgctggccctggagcactggagtgctaccactgacccccctcaaaaggatggatgctgcatggcccctgctctcctattcgatctctaaggaggttatcatcttatttgtggagccatatgtttgttacaagggaagctcgtagagtattaagctttttcagcttctagagtgagaggcaggctctgtctcatggggtgggagattcctcaaagacagtagaggagtttagagcctgagctgcctgaaagaatatccgccccagggtgcattgccaaagtgtgaaaatgggtagagtaaactactcttggtcagactctgcagagaacacaggctgaagatgctgtggtacaaagcatctaggctccaagaaggaggtgctaccccctactggggccagctgaatgaaggcaattctttagggttgttaccccctgcaatttcagtttaatccttggactttaaggtagtacttaagtttcccatctcgcatatttcctagatcatgtattcacatgctcaaaatcctccagaggcttcccatctcaaattagagccacagttcttaatattgctgatgagatcctgcaagcgctgcctcgactcccctgccttcgctcctttgactcccaactcaccaactatactggatccttgctgttcctagagaaacccaagcactgtccctctagggattttacacttgttcttattgaggccttcatacaaagacccctacatatgaaacagagacttggccccacctgccatacttccttttctctttaccctgcactatttttcaccttagcgcttactaccatccaatatactacagacttgtgtatttccttattgcctgttttctccccctagaattttagctacatggggaaaggaattttcttttgttagaggccatatctccagtgcccagaacagagccagcctggtatgttgcaggcccttagtcaatatttgttgaatgaattaaagaattgttagatttgatgcccttgttctgatgcaacttgttattgttgtaaaataatcttgaactgcggccaatgaagagaaggtttctgaatggatgcaagtgtgtctgtaatataaattttagtaataatttctaaacaagtgtatgtgtgttgtgtgtgtatgtatggaggggaaagagacacacacaacattttatgtatatagtaactttatacaccactgtactgatttattttattcacattacttatttctttctagagttatcttactcaattggttatgtgtttactggcagtgctgactggatcataagctccgtaagggtagggactttgctttgttccttcctgcatctccagaaaccagaatagtacctcatatataaattagaaggtgatcaataacatttgttgaatgaatgatcattttaatcatcctcatcatcaccaccattattatttgccatagtaggatattttgattttggtataccaataaataattcctattgatttgcaagaacatgaatagaagagagtggagaatggtatagccaacaaatagaccaaggtgtccttgactgcctggctgtggtagtgcttgtatatggcccagtgagttgggaatccaggaaagggtggtctattaacttgctggtcaaggacaggtagtcattcagttggatttggatactttagcaagaatttttcaaagctttcgtattacctagtgacagcaaatgcgtgaatcaatcaaacaggcatgccaaaagtcactgggcgctttgacatgaagataccaacagctcagctgcatacatagtatttatcttacccaaaccttatacatgtatcagccatccttagttgagtaaaaaaagtcttagaggcatggcaaatgaaaatgaaaactggattcatgggtagatacttcatgaatgagaaatgtacaaatttaaacaaacgtgagatggtctaatttattgggatgcttttattaagcaagtataaatggaacatcacaggagagaaggctggtagttcttcaggctgtagaagctgcatttctgttctaaaccacaccatcacgatcattagtcattcatgattgaaatcaatgattccaccttctgacggcatttgttcactgttcccaggaactgccttctcacttccctcaagagggcttttagaactttaagctttctctctcggcctgtttattgtgcactgttcatttgcagagtggctgcagtatcctgtgccagtttggcagcgtaaggaggatttgctcttacattctcccaagaataagtgttagctctctggtgacttagaattcccttccaaatgacgactgtggctggagagcccaggaactttgtgccaatcagtcctcgtttctatagctacgaaagtcccttgaaacagtgacagaaaataagagcagattgttctcaatttccgaattcattgatatgaaatgttaaaaaaaatgcaccactaaattcactctcaaggtgattattttctcttttggtgcactcctgtgctcacgctctttttctctctttcttgcctactgttgggattgtagaaatatcactggttgctcctcaaatgccattcatccctcctgtcccccttcctcatgtagcccctcatataacctcttttttttttttatttgagaaggagtctcgctctgttgcccagcctggagtgcagtggtgcgatcttggctcactgcaagctccgcctcccgggttcacgttattatcctgcctcagcctcccaagtagctgggacaacaggcgcctgtcaccatgcccggctaattttttttttttttgtatttttagtagagatggggtttcaccgtgttagccaggatggtctggatctcttgacctcgtgatccacccacctcagcctcccaaagtgctgggattgcaggtgtgagccactgtgcctggcccctcttttttttttttttttttgacagagtcttgttctgtgtcttggctccctacagcctcgacctcctgggctcaagcgatcctcccatttcagctgccaagtagctgggactacaggcacatgccaccatgcccagctaaattttgcgttttctgtagagatgggggtcttgctatgttgccccagctggtctcaaactcctggcctcaagagatctacctgcctcccaaagtgctgggattacaggagtgagccagagcacttagcctgccccttttagttgctattgatttcagggaagattggcgctaaccacagggtatttactatgattggtgtaagccattgactgacttagggatgagcatttcactcagtgcttatcaatgagatgggaggggaagtctgcctagcacatttatgagaaaaatttcccttccttaaaacaaaatgagacaaacaaacaagtagaagcaaaaatagtccttttctgttttcatttccaaatggcaggtgtgatcagacaacacctgtaggtgcttttaccatctagacaccatgggggaacatagttgaaagaccaaggagaaaatgagactgtgaaggctggaggaaaccttggtacttaattgtgctgataagttcaccaatctggaaacctctttacctccagagttcttgttacgtgagattgaaggaaaaaaaatcctaatattgtttaagtcatttgagttgggttttctcctactggcagctaagctcaaagcatcctaaaccatttcatttctccttgtttgctccacctgtctttctaattcccctctcttcactggtttggggacttctgaacaacaatgagactttctagtaattactatgtcaagttatcaagatgttgagcctccatttccaacagaagactaattattgagtctatttttaagtgctagaaaactcagtgtttttgtattgtattttcactatacaaaatgccattgcatatttttctatttcagcaggctttgaaagtcctgccatgtgaggaaatcctaggacaagaagatatttaataatcccaaacgtactgggagaaagaaaatatttctgtcaaatcccatgtttatatatacatctacgtcactcttaagtagctaaaatggattttttaaaatcacaggaataacttataattgttccaaacattctctttcctttatgttctcctccctatttctgctattggtgctatcattctcttagtcatccacacttaaaatctctgatatatttttggctcctccctctctctttttttttttttttttgagatggagtcttgctctttcgcccaggctggagtgcaatggcgtgatcttggctcactgcaacctctgcctcctgggttcaagtgattctcctgcctccgcctcctgagtagctgggattacaggtgcgtgccaccacgaccagctaattcttgtatttttagtagaaacggggtttcaccatgctggtcaggctggtctcgaactcctgaccttgtgatccacccacttcgttctcccaaagtgctgggattacaggcatgagccactgtacctggctggctcctccctctctcttgtgccggaaaccatctgttgcagggtccctgatgatgccatcttagaaatgtctcttacaatccttccttgtgaaccaccctcactgccactaacctaggtcagacctcatcagcagcctcctgaagtgccctcttgcctccactttttctccattcatcgttctaaagctggggtttgccaggcccactcacttcttagtgagtccacactgtccgagtggtagggccagagcttgcacatggtcattcaaggtccctgagtcagctgcagctgatgatgcccaccttcttcctcatgccacctgcatcatattccagagtccagtcaagtgcagccttgcccttatgaccatgccctcttatttgacattgagtctctttcttggaaagtctttcttccttacatttatctgttcaaatcttatctaccattcacagattatctgaaattatctttttcttcacaaggttctcctgattcctccaagtcagaagtatgctatgccctcccttgaatttcactaagattttatctctttatcaatgaaggcatttattactggtatttactactttcttctatttataatagttattcactgcatatctgatgcagtctccaaaaaggtgaagttcttcaggacaggaaccatttttgttcacttttgtgttatctttggagcatgttatttccttgaccattgcaaccccaataaagaaaattgaattactgcaaagtgactggctttctgcttcttctgggtgtccaaaccttatcagctgattaattaaaatgtaataaagaaaaaaggaaaattatttgattcagctgatcagtcatgaggaagacttctttaaggagtgatgaatttagagttatgtcagatacaaaataggatatcttagttttctgtttcagagatagtcttaatcagaaagacacttttaataacataagtgcttcaggattattcaccaaatttataagcattttttggttttcatctgaagattattacttgaactttacaaaagaatgattgctttgcttcgttgagaagcatcactttctgatgagtcaggatgtaccaatatcaagatgagggatatttttataaaaacaaacatctatttttttcctggccaacttttctactcatcagaattagtgcactgctcttcacttgtaggaatcctgatgagacacgcaattacctagttaccaattaacataaagaagatcttgtggaacttcgggaatccctaatcagctggtctgcagaaaaacaacacagcccacaggcgcgcatgggggaattatgagaaatatttggaatcactgtccacattttcttatccttacacatttttccagctatttgtcttaaatttaatacacagtatgaagtagaaatagacccagggttattagatcagagaaactgatcagggtaaatatgtcctattcatttctacagactgattgcttaccgggtaagaagagaatgtaactccataccacaataggatttgttcccattcagtttaagaacagattacaaagtaagcactttcataattggtgaaattaaattcctgagtatttagtaagaacaaggaagattttatttgcacaatattctcataaaagtaaaaaacaactgagcctaccttccatccatatctggatctaacatttccttcaacaggtggtgataaagaggccacgaggcactcagagaagcacagcaagtaagtagaaagaagtgatttacacagagagttcaaaaggatttctaccatttagttaaataatacctagagtccagactcttgtgaccctgcaaatgctgggaaagaggatttacagcgaggttgggcggggctgatgttacataagaaagcagccactgagccacgcacactgccagatgccaggtcagccaggagctcagggatccaaggcccctctcagactcctggtgcagcgattatagagttcagccatttaggagagtgtgacagagtggcggcagatggcccctagcagaaataagttttgaatctggctctgaatcccaccctcactactgcctctagaatgtcattaaacttaagcagaggagaggaatgtcagaaccaagacaaagaactgtctttggttgagagggtgtttctgtccacttgctgtgccatgcaggacgtgagacgggatagggagatttcatgtgtgtcataggctgatgtggttctgccattgtaagatcagccctcttgacatagtgactgtttccgagaataatcataatgaatcacaaacctgttagcacttttttctcctccttacctgcctctggctgccagcgaagtgctgggttgaaagtgtgtgaagtgtgtgcacgtgcacacatgaacacgtgcaggtgtggtgggaagggggcacatgggtgtgtaagcagtctgtcacatagggaagcagttcagggcccaatagcttgaggcctctgagatgagtttacttgtcctgaagaacaagggtgaacaaaggcagtgttctcatggtggtgacagcagcggggtgcaggtcagtggaggctcagaaaggggaaagttaaaatgagctatgaggtccagcaatccggacaataagaaggagtcaggtgagtggagataaattaggcctgatcaccttgaagtttggaaagagaggtggaattaaggagatacactggcttatccttcaaagccccctataaaacatgtggaaacattaactcacagcattgaaaacggatgtttggacattttttatgtgtgttagggggtgcatatggtgaccaagaatgtctggaggtgaccagagataactgtggcagaaatatgagaaccagtaaaagccaatatttcctggaggatatcagcaattgcctgtgtaaatttaagcactggcctatctgtgagtatctggctaactttaagacagaaggaaaacaaaggaattcattaccccctggaggctgaggacaaagccagggatctggtccagcctttccccataagaagaccaagacagggaggcatatgaagaccaggaatatagttctccagttccatccatgttatgttaagtgaaataatccaggaacagaacggtaaacagtgcatgttctcactcacatgtggaagctaaaagagctgatctcatagaagtaataagtgctacagaggagactagaggctgggaagaggaagagagggaagacgaaggaggtaagggagagatagggatatatttgataaaaggatactaaattacagctaaataggaggaataagttccagtgttctataccattataggatgactaaagttaacaattatttttacatattttcaaatagctggaagggggatattgaatgttcccaacacaaagaaatgataaatggccaggcgcagtggctcacgcctgtaatcccagcactttgggaggctgagatgggtggatcacctcaggtcaggagtttgaaaccagcctggccaacatggtgaaaccctgtctctattaaaaatacaaaaattagtggggtgcggtggtgggtgcctgtaatcccagctactcagaaggctgaggcaggagaatcgcttgaacctggagggcggaggttgcagtgatccgagatcgcaccactgcactccagcctgggcaaaagagtgagactccatctccaaaaaacaaacaaaaaaaaagataaatgtttgagacaatggatatgctagttaccttgatctgatcacagcacattatatgtattaaaacatcactatggtacccccatgaatatgtgcaattattatctgagaattaaaaaagacaaggagaaactggacttctctgaggaagtaggaggtaatggtaatttcttggaaaaatgaagcggcagcaagctacagaagtccttctttccatgagcggtgtgaacggtgctcctgaacatccacaggcactggctgggtaaaacgaaatgtgatcgatctcaaaatgcacaggctcgagattttggagtcaatacatgtttaaattggcatatcatgctagttatgtctatatctactcctgtctcagtcttcaaataattccctcgcttaacgagctgtattttcctcttcttgcagcaatgagattcaccagtgctgccctgtttgcggcctgaaagcaaatcagggaagacagacaccttctcatttaggaaaggaaaatttaaactcatcagctgcttatgggttacttttctattttttcttttctttttttcttttttcttttctttttttttttttttgagataaagtctcgctctgttgtccaggctggggtgcgatggcgggatctcagctcactgcaacctccgcctcccgggttcaagtaattcttccgcctcaggctcctgagtagctgggattacaggtgcccaaaaacacgcctggctaattttcgtctttttagtagagacagggtttcaccatgttggccaggctggtctcgagctcctgacctcgggtgatctgcccgtctcagctttccaaagtgctgggattacaggcatgaaccaccgcacccggccggttacttttctattgaaggcagtctagcttgatgaggattgcagagaaggcagaacaggctctagaaactggattctccaattctgttttccactagaattttgctttgtttcttttgaggaaaaagaaacctagaacacaggagggcaccctggacagtgaatgtgttaacctggagtcgtggtgcatttaccgtccctgccaatatctgcactgcagaaaggatgtggttttattctgctggaccctccggtgactatcaagtgcttggagagaccatgacatgtaatgacatgaaagtaatttcggtgtcacaatttatttctcttgaattcactgtagatttctaattgtagaaaatcatctcaccatgacaagactagagtggacaaaagccttttaaacagccctttcaaatattaggtccaagtagcaaagaaaagaaaatgggggtaaaagttacattctattctcaaaaaaagaaatctacccagagaaaccattgtcttagtctctctgggctgctgtaataacacagcctgagtggattataaacaacagaaatttattgcttacagttccaaggcttgggctggaacactgggcttggactgaccagcttaagccatgccagtaatatctatatctgctcccttctcaatcttgagatcaaggtgagcaatttattgcttggaactgtgagcagtaagtttctgatcaaggtgctggctgacatagtgagggcccgttttgtcatagatgataccttcttgttttgttctcacatggtagaaagggcaaacgaaagggatctctttcataaaggaattaatcctacttatgaaggcttcacctccatgccctaatctgctcctaaaggccccacctatttattgcattggggggacacagacatccagaccagagcaaccatcccgggaaaaggggtctggacaagcatggttttcggtccaaagaagttcttcaaaacgtacttttaacatttcactgggccttatgaataaacacatttaatccagtccccccaaatcctagttagctggaggacatattgttttcattttattaacagttgctaaagccagcaatccttaaagttccctgggaagcattgtggagatagggatgtgagctcatagccagtagctgcagaatgtattatggacttgggaaaattacttcaccttttcattctttagaatatggaactgtctattatttgagctaaactacctgtaagacaaggaggaaggagagtgaatattgttatagacggtaaaccgaagacttaacagtttacctggctttatctaaatactctttgataccaaaaaaatgatgggaaatgttacatcctgctgttgataaataagtataaacaattttgcaaaactgaaatacatcatgtgcagagaaaatagaacaaaagttaggtattactgaataaaattaaacatcatagttggagtgtggactagagatttctgtgcttagtcctgagttttgagtggaaaatgcagtatagcaatgttattgatgctacaagtataaagaacatttttgagcttaatggaaataaagtatcctagtttatcactctcaaaataaataagcatttgaagaatgctttaatgttgctacttaactgacaagcggccctccactatcccagggaataatttcttggaaatgatttgacgagttaatttttttttttttttggagacagaatcttgctctgtcatccaggctggagtacagtggcatgatcttggctctcagctcactgcaacctccacctcctgggttcaagtgattctcctgcctcagcctcccatgtagctgggattacaggtacctaccaccatgcctggctaatttttgtatttttattttatttatttatttaatttgagatggagtctcgctctgttgtccaggctggagtacagtggcacgatctcagctcaactgcaacctctgcctcctgggttaaagtgatttccggctaatttttatatttttagtagagatggggcttcaccatgttggccaggctggtcttgaactcctggcctcaagtaatctcctgcctcagtctctcaaagtgctgggattacaggcatgagccaccgcgcccagcaacaagtcaatttttataacaggacaccagatagcttagaccaaaatgctttaaggattgaggtttgcatcattgaggagacaaccaagattcagactgaagggatatcttgactagaaattaggttaatgaggataactttctgtgattgtaaggattaatttacattaagcagacagattatttgctgtattttaaaaattcattgctatccggccatggctgatcctggggagcaggatgaagtagaagttatttttcagttttcttatgcttctcttaggcaactcgtgtcctgtgcttccaagaggtctgcctttctgatgctttctgtctgtgcaggtcctccagccaggccagccctcccagaagtcctgcagtgatcaacatccctcttctttaccctcttcaacacccctgtcctcctaggctctctgatttcagtgggttcttaggtagagtcataggattaaatcagctcatactatgagttaataattcctgacaggggctaatggtgattacaagtctagggtgtttgcataagaagaacaatgttctactgaagaaataaatctttcatggtgacatttcagtggctttgaatgagaacccttccagtgtcattgtgaccctgttccagcgatctacctcctgcagcctccttggagtttgggccaaggttcttttccctcaacactgtggccagttgttttaacttcactacttgggatggtaattggcattaggcgttttaccaagttctttaagcctttcttaatataacatctgaattgggagatagctcattgtggcctgggtgctggacttttcatattaagtcctgtcttagccaagggagaagaatgtaaggataagaccaccaatatcacaggggctgtctgagcctttacctgtgattttctaccactctgtggccttctggagcaatggtgagtactagacattttgataatggagggagtacttctctttgagactttaaaagccatgttcaaaccatatctttcttctgagttctacatctgttggctgcaagggtactttagggtgtgaactggacgtccaggagtcccccactgtgacctacagctgcctgagggtagctgtaacaggtggccctgcttctcaagggttttctaggacttctagtgtatggatgtccccagttcacaaaccaggtctctgtcttgattgtacaagttattttaaagtgacaggaaatcagacaccaagaaactgataaattggcacatatttttatggaaaaacacactcactacaattggtttcagacatgcttcagttatctaattaagcagagtttactgatttttttaaaaagtgtgttctgggggtgggagggatggaggtgtgtttatatatggaactatgaaggatctttgtggtgacggaaacgttctatatcttgattgtggtggatacacaacctacaatgcgataaaattgaatagaacacacacacacacacaaataggtacatgtaaaactgggtaattctgagtcagagttgaaaactgtataatgtcaatatcctggtaatgatactagagatgttatcactgagagaaactgggtagaggatacgcaggacttctctgtactgtttcttacatgcgaatctacaattatctcaaaataaaaagtctaatttaaaaatatgtgttctggccaggcacggtggctcacatctgtaatcccagcactttggaaggccgagatgggcggatcacctgaggtcaggagatcgagaccagcctggccaacagggtgaaaccctgtctctactaaaatatacaaaaatttgccaggcgtagtggcgggtgcctgtaattccagctacttgggaggctgaggcaggagaattgcttgaatctgcaaggtggaggttgcagtgagccaagattgcgccactgcactgcagcttgggtggccaagtgagactctgtttcaaaaaaaaaaaaaaaaaaaagtgttctatgtcccaggcttggagtatttagaaagataaaattcatacatgcaacagataagcaaacacacatgttcacgacagttgtcagggttcagcccaccacagtgagtacacacattttgctacctgttggagtgagacagttttatgtttgggcaatggactgaatctaaattaggtatcataaagcataaccatcctttttagatctctcatgcacaagaaaatcatgactatattagaaattctctatgctggtgaatgtagttgtttaatgtggcgggcacctgtgatcccagctacttaggaggctgaagtgggagaatcgcttgaacctggtgggcagaggttgcagtgagtcaagattgtgccacggcactccagcctgggtgacaaagcaagattccatttcaaaaaaaaaaaaaaaaaaaaagaagaaggtttgtaactctatatttgtattgatttttatattgaagtatttttaaaaaatataaagaaaaaggtttaaaaagccaaattcaattccatatgtaagaacttggaggaaatgtgttaaatgttttatgggttcttgcaatcttttccccaccacatagacccatttgtgagcatagcataacaatatattatccttatgtgatagcagaaatcttcaagcttcagataaagaaacatttatagatcacccacctgctctgcttttataatcatactataaatctctcattgattcaaaatgattgggaataaaatgtttgactaataggttactgagagtttgtgagcttgtatgaaacacagcaattaccaatttcaagggattcaaagaaagtcgaatatattttaatccaatcacctcaaattcattatggaatgagagaaggtaataaaatagtcaacatgatactaaaatatttatttttaaatttggatttttttttcaggatctgttggggttcagaaatatcattagtgtatctcaactattattgtgaaaacaatttaggctgaattgatacagaaagttgttctgcacattaaacaatctaacaatcacagattcctcttactgtcattttttccctataaatagaatgtagactatgcaattaaattttctgaggtcttcgacactttcagatttattatttaaatttttcttttttctctcaacaatcatcacagatcaaatttcttattagatgaaaacacttccataaatttgatgccaggtcctagtttttgtatggtttcaaataatttcagacacacacagcattaaactgacaaagggcctgctacatggcagatgagttttctcttggaatctattctataaccaagcattttacatcacgcataagtagctggtctgctggtcagacagctgaggtaatgctagcagggaagaaaacagaaaacaccagctaactatgagggaatctatgcagctgttacaggattactttaccttcttcagacacacgtttttatttccattttgtgtaaaaactttcgtggtttgcagaattatgaatcctcttaaagctctgggactttgttcatccatctcaccaactgtctaaacagaagtctacagcaccagcagacacagtagtaaatctgacttaaatcagaggcactgatcacttaagcattctccaatgtacatcagcttcatataaatcatgaaaactttcaggaaatagatgctgtgcagcatttatgctgaacagcaaaaagtcccctaattttgttggatttctatgctcaggtgattttttgcatggttcactgggattcctattccataatgaactttaaaacacaaatgaattgcaagaaaatccacttcgtttagttagttgcaagggctcaccaaaacaattcacctttttcaatgaactgggccagaggtagaaaatacattggtagtgagcaatttgttttttgaaaaattcatattactgtatcaaccttcatttttaaagattacgtaatatttgttacttcatatcttgggaaaattattttccccttgtgtccttattttatctaatagtgtaaatgcaattggtgccggctataattcaattgctattttaaaatacctcaatatgccacttcataaacgtatttatctgtagctgtatcatctatctatcaatcatctatctatctatctatctatctatctatctatctatctatctatccatccttctttcagggagtcaattctaatggtccttcaaaaacatactaatcaaccaaggcaattaatctgctggttcactcattttcttccctggttactgaacaactctttaaggagctgtagctttacggcatctcagggggtggggggtataactgattctgtctttaacatccctgttgacagaaaccatttactcaaaagggtgttcaccacatggcatatagctaatgtagtagtatcaggtgcacccaatctttttttgtaatcatctcttttatatataattttagttttgtcttgacagtaaagatgattttattgtggcaggactaactcatgcttccagctccagatggctcaacaaggactggtggggtactactattaggatttttgactcaacacttaacacctaacaacagaacatgcatgagatcataagctccccatttctcagagattttcagacagagctcaactactacttgccagggatatcgtagaataaatttgtataatacaaatcttgaaataaatcagataccctcacacatattttccaactctgtgactatacgcttctttgaaaatcatttgttaatgttaagcctgactgatatatcccctttagacccatgcagaacacggcattccaaaacctgaaaaaaaaattagcagtttgttctggtcttgaaaataggatcagccaaaatttcccagttaggacaaaagtttcctgttttctcatttgtgatgacacgctgttaattcttccatttatgccaatgtaattcgcttaaatccttttttacttgagcaaacctgtggatggctgcaagcacagcttattggataactcactcagctattttgtttgcctgtttgttctgtcctgcactacaatactgatttgctgccagtttcttttgttgcactttccatttggtagtctcctttcttggttcacttatgcacacttcacaaaatcatctcaaccaagaggaagttcatttttgctgtttactgattgtcaaataaacctacttagcatgttcttggatttggtgttgtctaggtgctttgtggcatttctgctactgatgccttctccctgtggaatgttttagggatgtgagtttctttcttggattccctaaagcaagctcaatatgatgtgctaaaaattatttcttgatatagattaaaatcgattgctatacgatttgtcaggacagagttaggcttctgtagtgggatgaaattatgcaggttttacatacaaattacttcatttttctcttttcccaagaaatgctgcagatgcaaagggtaggggtaagagctgaatgcaggttttataccactggaaagaatgagtcaagccacagttacacacccttcaggtgggacacaacacacattccacacagctgtgcaaaccctttattaaagcatcaatcaaaatacaggatggatcacatggttttctgtttttgctactgtaataccaacttatatgagtaacttgtttacaactttatttttaaaagtgaacattttacagttcacagaatcaccagattgacatttctgtcgagacatttttccattttccaattttaacaaaggacatccagaactactgaaatacaacaaacgaaatctaagtgcaagcatcttccttgattctcattgttagcagctctatggtgtctgagatatacatttggaggctattttattggctaaataaaaataatttatgccagaatattcttagaactatttactttctatttttacattctctagcttcaattttgattgtagtattcttagtatcagcctctttataaattctatctctaaaaaatctgttaaagatcattatcatcctcatatgatatcttcgtgaataaaagataaatgctcagtcctttggaaaatataataagcaattgttttatttgatttttcccccacaattgatttgtgtaacccaaacctggttgatcaatgaagaaaccctaaaaatgtcattaggaaaataaactgtgctatttactgaaggattttttaaaatgaccagtatcttgatgctcaaaatatgtgaaaatacaatgagatttggtagatattttaagagtatgaataacttggtttaaaaaccaaggatagaaacatttatagaattactcaatgccaaaagggtacgtgaagagcggtaaaggaaagtatctgaacaatgctgagaaaacagagtatctgaaatgtaaggtaaatgttctgttttggtaccaaatgaaacactgaaaggaaatccccagttaaaagaaccacagtgactgccactgaagagttttagcactgatcaacactgtatttcctagggcagaataaaaggtatctggtttgcctttctaaaccatttcttccagcagctggaattggtgtttctacagtcaagttaatttgtgttggctgcacggggcttagagcatgctgttccaaacatgcaaatgtcctttgtacctgattttcttcatgtgctaaagagctgagcagatcctagatcaccaataaataaagatccaagcatgagacttgaaacatcttatcagtccattaaaataatttacatagccataggtaaattcatccagtctttccatcacattgctttcttgttatctcacatttgcccttcaaaacaaagtttcgacaacatagactggtgcaattaaaaatgaaacaaacaataaaaacagataaaggaggaaaggggaattccagaaccccattgtgtgagatgtcaggtctttcaaccttagttgtgaaaaacaaatgctcataagcatccaagacaaatcattctggacataatgacacagcacaataatgcttgggatggatgagacattcagagatttttagagcgatttctagaagctatatatcacatgtatcacgtttggttcctagagattttagtcaagtattagtatttctttttgctaagtatggtatacaaaaagatgaggatagatgtgccctagagatatgaaaatataatatataaaacaaaaccattataaattacatagatttttccatataaaattgttttccccatttagaataaataccatccaagtttacagatcatctaagtgaattaaatgtacacacatatgtgaatcattttcagaatttcaagaaaaacattgctagagatatgaccaggatgactcagaagccagaaattgattttacaaacgactacatacgacccaaaggacgaggctttggatttagtgtgaagcttttaaaactgcccaaatgagtccaatgtgcacgagtgtgtatgcacacacgttcagtcacactcgcatgaatttctatgaagctgaacagttcactttatctttgaaaaatcagctgaaagtcatgaggtcttctgcatttcatattctagcaggagggcctctcatttcataaagaagctgtaggatggataggaagagtgtagcatttttggaaggagaaattcccattttaagtcaacctccctttatgtcagttgttatcaaaaccgagagcattatgatgccttaaagagggagaaagttttgaaaatctacataagctctccccactgcagtctaaagcagcaaaaccaatcaggaaacattctttggccgcatatttctgctcttgctccactgaaaatctgcccacttttagcttattatcactattcaatgtctaggtggaatggatgccttctcctttccatgtggaaacctacacatgggtttgggtggaatgacaactgaataggatggggtaacatccatacagtatcacaaaatgaacttaagtcctctgttgttgctttgggcatataaacccatggtaatgaatctgtggacctccatgacaactggaaaatttttatattctaagaggtggtgttaaaacttttctgcaacccaaaaacatacaatgctagtccagaaagcccaacaggagtcataatttctcctgatttctcactgctcatttctttatgtgactgcccaaagcacttctaaccagaagtcaacagttcagtccttttcaagagatgtctcatcaaactccatgactagttctatcaccttccacaacagttatctataaacaaactaatcaaggctaggtttaaaaccaagcccactgctctcaattacagagccagataatgtttgttgtaaagtttggatggcaaaagtatccaatttcatggacccattttttgcttgtctcatgcaacgggggttggttatcctggaagactgcaaactttctgtgaactataaatgtttcaactagaagggatcctgtagaccctcgagtactacctgcatattttacagatgaaaaagattaaatcccagagagaggaagggagttgtccaaggtcacctcctcagatggtgacagagtgaggactaaacatctgggtctgctctcatcaccaatgtgatccatgcaatcttggacatcataaccccattacctgatgtggccacggcccctatgaatttattaagattactgtctcctttgcttttaagggaaaattaaataaaaccactcattctcaccaatattaaatcttaattgcagatgtggtcctaatggtttttttggaaggagaagatccacaatttgtttaaaatgctatttctcaaaaccaacattcttatttaagtaatgaagcatgaaaatgttaggtggaccaagagatgaaagcaaaaatctttaaagtcattgtgaaaaggagcaaggatgtgaatattggtttggttctgtgtgacagtgataccatttcaacagtgctcagagctcatgtcatctgccccttctacagataagggacctgaggtccagacttgtccaaagccaggcagctggttattggcacagtgggtattaagcctttggatgactaattttgtcttctttccataacatcacgcacctcacatataaccactttcttgcaggactgcataattattcaacagttttggcataaaatctgatggcacagttccctttgctattaccctaacctttcgctttcctctttaaggacaaccaagtcagctatgcagttcataaaagtggacctggttatatgtcatccaacagcatatggtccctgcaagcctgtttggaagccaatattctataacctacaggaatccactgaatctgatgtctttggaagcaatatattttccaggtaaagaatcagtctttatttggaggatgatgtaacttaaacagtgactttcatgggtggtgtgggtatatttaaccttttacaatctccctctacatctcagctgagctcaccaaaaggctcactcaatcagacaggtaaacacatttttgactattaaagtgctattccggggcaaagtttttctcagtttcgtttaacagcagcttcgttggaaacaaacaaaaaaagctatctatggaaataggcctggggaatgaaaaaaaaataacaagcctcgtaactactttggaacatgacaaatgtaatgtgacttgtagatatcagccctggtactggtgactgataccaaagtctctgaggtacgtgttctagggaaacataaggacaaaagtggcaatgaggactaaaccagaaagaacaattagtattaataacaatgaccccattataaaggaaaagcaaaattaaaactgagaagaaactgcaaaaaacccacgtacgtgcatttgctattgtagcagacctatactttttaaaaggaaaagcaatgcagggggcactggacagggttcttgaactcagaatatcttacagtggtgtactctttgccaagaaggcatcaccaattaaggtatttggcagagatcagcctctgaaactcattatcacatagacaccttctgtctggtatcaattctgcaccctgatgtttctcgcacccttctctactggggaaattccagtcccattcactgcaggcaggtgtttctccttttaaagtggcatcactcctacctaagggatgagagtctcctggtaaggcttagcggcaagtgcgtactacatctgtattacaaggagcagcccctgattttcttgatatgcatagcttttcggggttggtattagacatggctttcgtaaataatgcaggtgtttttgtcatgtgtcactgctggctctgtggcttccaggtaagctggcggcagtaccttatctggtacctcaacaggtgttggctcttcagatgttagctcggtggacgtgacatcggtagaaggttctgcagtttcgggggaatgttccgccgacagttctgtctcctctacatctttgacttcaaactgtccaccctcttggtcatctgcatgctcttttttggactgcgggtgaactgacaccttgatggcaatttgctgaggttgctcgtgcagcgatgaggcgtccgagtcagcggcaggggagtcgctccgcttcagagagttggggattgtgtagacctcatccctgtctgcggcctcctggccctctggagtatgcctcacaaaattctgcccctgctcctccagcccaaccacctccataatctcctccatgatagtcctgcagttcataatgagaggcggcagaggcacgctcctggcaagctcttcgatgtagcgggcgaactccatggttttgaactgggtgactttggcaagctctagagttttggcggaggtgatgatggggatgcgcttggcgatctcaaatgccttctgcagcttctctgcaccttcggtcctaaagaactcattgatggccttctcagtcttctttagatggctgctcatcatgcacaggcgggtgatattgaggaccatgacgatggtgaaggccaccaggcacacgaccatgtagtagacacccatgtctccagaagtgaagatgacgcgcaaggtcaccgtgttgttcacggtgccgtagatgttagaagccacacacgtgtatttacctcggtctgagaaggataccttggtgatgttcaggaggccgctgtcgtgcatttgccattttcctgtcggaagggagagaagagaattcaaccaaggacacagagctcccatgactacaaactgatacgtttctaagaacatctatgaacatctatgaagaacatctatgaagtctatgaacgtcgacttcacatgcttactatgcggcaggcagtgacatgcatcagctcatttaatcctcacaataactctgcaaggtggcccctgacactgcctccgttttacaggatgaggaaactgaggcacagtcaggttagacaacactcccaagggcaccggcttggaagccgtagaactgaagatgaacttgagttccagaggctgcactcttaactaccaaaccatattgtctaactccacatcctagtgaaaaatgagagaaacaatctggaaaacactgtgctcttattgaagagttccttaactttaaaagcaactggttctctaacctgccagtgagcatgcctccattgaatatatgttcactggggaggttaatgcaattaaattgtttacctgagtttctcaaatttaagattgaagtaatccttgtatgatctcagttaattaaaacataatttgtatcattcattttgagactccacagtgaattatctatactatttaaagttacaagctaacaatgtgagtattcagaggctggatatgaattaatatcaatttgttttagccttgcaaataaattacagacccatcaagttgaaaataagcttgacacgaaggagaacacatactgataataaatgcgagttttcttacccccaccaccctctctggaaaggatctagcatcgcctcaggaatgatattttgaattcagtgaaacactttggtttgaatttagcctgcccatctacctgcaggtcaaagacccctgtgaaacatgatactagacgtggcttcagggtgttaggtctgagcccttctgaaaccctactacctccctggactgtcccatagagcaaatgaagatcccagttaggcttttggggagttctaaggaacaggcaaatatttctccataaaaacattctagttccccgagccgactagagaaacctctcctgagagctggggcaactgaacgcagtttcaagtatctattattgcactgtatattatttgtttgctctccttatggtagtgagttttaattctaatagaaagcctggtatttcccaaaagcaactcttttttgttgttttttgttgttaatacagggttccaatggactacggaataaggcaacacagggcctgttttcccgcagtgtcctctgctccaaggaactttcttaaggaagcgggacgtgtcaatgaggtacctcccggggttctacagttcctcctgcccactggccagggggaatctggcgggagcctctcggtggatgctgtcacatgactgtgccttctgaaagaacatctgtgaagagcagtttctggtgtccctgagtaacccttttctaacaattcagccagtgtatttcctccaagagtagaaaacactggcttggaaaatctagtgaattttcagcttcttgtgaatgtgtatgaacaaaccaacctactcggtctgtgaaattctcgctaattcagatgggacatgggcaaggcttctaatactttcatcccatgaacataaattttgatatttcagctgcagattttttcaaatatacaatgacctgaggccaggaaagttaccttgtcaatttattttcttataatttgcatgtcttataaaagtagactacagcaggcatggacaaaaacagaacaaaagtctaactgattgaaagcttattccatagagaagacattgggttctagagacttacaggctatgcttgtagtttctcatatttaccttccttttgttggaaaatatagcagaaaatagagtggaggagggtgagaaggtgaggttatttgtgtgaagaatggttaggatcagtttgtttacctcctccccatccgtaccactttttggaacagttatctgtaaatataaggataaagtagtctgaacctgggtacagaagaggagaacactaacaagacaggcatctgatggtaataccaacagctttttccccaaacctaagttacaactttagtgatcattatgttctaattgttatagaaaaataaaatgtgaaaatactagttacaacatcccaatgctttcctctattgaatatttaaaaatgtttctgaacgtgaactttgagttttcagatatgattttaattgtgtattgatatgtatttctctaatctacaaccaagcagttcaatttagacaactacttacaggcacttcaaacatttcttgtgacattgttaaaaggggcatagcttggaatcaaatgcagtctaattaggtgatatgtgtggttcattttggggaaatctgtgagatgtctaacagataaattattacttaggagtatattcagattcttagcccagcacattgggtccacagactaatggttttcatatactttatccaatatttaattttatttgttctgaaagttttaagcccagtcatatatctgtgaagtgactatattaactataaactatgacaaatgtgagtgcatatattataatcctaaagcaggtgggttattacctatagcatgagctgtaaccatctagttaaatgagatcatcacagctctctctgccagcaatttcctgtttccaatggaagacaaggataccaaaacgtctctttcgttttcagtccattactagattcctctggaaacaatcatcatctttattttatgggttaaggtaatgttaatgtcacttagaattctgggtgagatatgataaaatgagtatgtgacctggattaaaacatactattaccagaccacaaagcgagtccaagtctttggaagccaacacagttctaagactatcatagaagagaactaaggtcccgtagcctccaaggttgtgtacgtctgtattcccccacccccttttttgtaaaggccagtatattaattcgttctgggaaccaagactccaaatatttcctctcagcctcagcctgcccttccattagtgaaaaataaagatttctgcacattctactgccacgtacagctctgaaaactaaagatggtgcaaattctgtttggaggctcctcccgcatcagctttgggctcatgctcaagaagaatctccatccacacggcacttgtccagacaggaacatctcgaaaacgttcttgctgctgcacattaccattcgcatcggtctataaatacctggccctgcatctcattctagaagggtcccgacttcagcttccagaaagttatacaaacacccacggtgactatcacagatcttcggggctttacacgcgaagtggggatacacagtgcagtccccatgtattttaaactgtaactgagtgggtatgtcaagcttatgcactgaatgttcatgaagctgcattgcttcagcacaaataaaacccaaaatgtcagtagcagatgccaggtcagttctacatgcaatgattttggaagaaacaacataggcagccatctcgccataaccttctgaatagaaaagactctcacgttcttcctgcacttgggctcagttacacacttcctgtcccttgagcagactgtagccccgccaccccccaccccccaccctgaaatacccttcctccatcccctctctctcagctcctgttctggaaagtgatgcacacctgaggctttaggctaaaatgctcacacacgctgcaggacaaaggctgctgcatctcacatctcctggagaccagaaattgccagggacctgtcacagtcttccccaagaaactccaggcacacgagttaaatgtgaaaatctcccagatgttgtttctgagctgtactgcagggcatgggttatgccacacaacaaagctgacatttgtagaagggcagtgatctttttttatcttgctcactaattcagtcaacaaatatcattgagcaaactgtgtaccaggctccaagctagatgatgggaatacaaagatgagttagacacgacccctgactgcaataaaacatccagttccaagagaaaaacagactccgagacacaaccacagcatcatgtggttaagtataatggcatctgggagggactgaaggggacagagagcaagggcttcctagaggaggccactgctaagccagatccgctggcacaggtagggagaggaatgcgagtaaaagagaaagaacttttgaggtcacagggagcacatgagcacaagagagaacactgtgagccgctggagctgaccactagaaaaccgagaagggctcagatggaggaaggcagggctggattacaggaggacccccaaatatgcaagagctttatatctatcctgcaggagacctggagccccgcctgcttcacgacctcatttacatgacttttcccctgacaggtttgccttactgtatttcttagaggggccacaggaccttccctcatgctccctctctgcctgcaaggacttcttcctccccaccccaagtcccagcctcacacatttagcccagttaagaccccatcctcaagtcttgctccatttcccaataaagccttgtgtgaactctgattaaatcagtggaggaaacctgaaagtccagaaccagatgcagccaagcgtgagaagtttaaagatgaagaccacagcatttcaaattgtggggggaggggcagggaagactattgggatagatgactgttcatttgcaagaaaataaaggcaaattcctactttatgtgatacataaaaataaattccaactactccgaagatctaaacataaaattagaagtataaaattaatggaggatataaaatatttttataacctggaaataggaagtcctttttaagcatttcaaacacctcagaagctgtaaaggaaaacaccagtggatcagatttcccctaaattaatttttttcaatataaaatacaccatattaaagttaaaagcaaatgacgggccaggagaaaattctagaatgtttgacaaatacttaatgactctaaaacataatgaacagctctaaatcaagcaagtcaagacaaacccaaaagaaaaaatgggaaaaggctatgaacagatcattggcaaaaacaagaaatgtgaatggtgtctatgtgtagaaaatcactaatatgtaaattatgattatagagatcacagtcatttttaaaacaactttttcaactctcaggttgccagaataaaggggagtcgctagtgacattgttggcagtggaaagtgacggctgcctggctgggtaggtataaggggcaggcccggtagctcacggcccttctatcacacacaactcaccgcagcctggatggccgactcctgcccagctcggcctcctttcattaattcttttttttttttttttaatattgctgagaatgtagggtaagggacactcccatgcactgcaggtagttgtcaggctggtaacactgttggaaggatgatttgatcacaacttaaaatgaaggtagcctatgatccactcttagacttcttgaaattcttcaaatcaggcaagcctaggttgactggaaaaacagcaatgatgtaaaccaaacaacgtaataataataaaaaaaatctttttaagaacagtgtttcttcccagggacatagttcagagctttcctctccagctcactttctctgggagaagccataactgtggtgggttccacaccgggaaggcagctgacctgggaccacggtgctcgccatggtggcatgcccacgtggtatggcccaatgtctcctcaataggacagtgccaggtagcccatctggcaatgagagaacagatcaatagcatcctatggttacaattaaacctgtaaatacaagagattctatggtacaggggtgactgtgacttagtgtgaaaccaacagatgacaacatcagaactaacgctcacacaaacaacttctgagcaaattactgctgtacagcaaggagcagcaatgagcaacgcattctgaactgaagaatcacagggaaagtgagagcacaacctccacaggtactgtaatcacagcttttctccaaacaccacttctactgaaaccttaaatctttccaggtttaccttaggatcactgagcgttaaaaattaacattttcaacttgagaaagctgactgaaaaaaaaaaattatacccaaatgctaagcttttaaaatttccaatctttttatgaatgcgtgtgtgtaaacagtgatggacgtatggtttgtctacattcccaatgagtggtataaacagattaaaactgtattaacgatcctgtttagacactttggctcttaagcctcacacacccatgcttttccaggagaagaattaaatctgccaaaacgagtatgttagtttcttgaaactaatttaaaaatattcagatagtgagagttccagtaaatgtttatgcaaacaataaatgaaatacaacatttattcaaacgaggattgcgtagaatcggcaccctttgaagaagcacaaaatgcgtgcatatgtgtttgtatctataaatgtggcacatattttgtgaaatacaggctactgaagagataggattcatgcctttttaccaaacataattgaaagcaaatttagcactgcatggctgcacctgttacaaggcatctgcagaagatgagagctccttgaagccactgcagcatcaggttatgaatcccagaagctgcaagtgctcttgtgcctccccaaccccactcacaaccctcccaagagacctcttcagagaggactagggcagctctaacaagctaattcttacatcatgtagagcgaaggtggcctgggataatatgggcttagccaagctttcaactcaggaaggtggggatggaaggattttgctgttcagaatctgtagttctgttctacttcaaggtactaatatctgaaaataacctactgtctttttatttcctggaaaaggaaacatctgttcctctagctaatttggtctggtaatcttaatttttaaaggagtgccaagcatgtaattccatagaacatggaatcataatacatgggctcataatagtcttttctagagagtagctacaggtggtcctccaaaataacagcaccctacacttagttcacattaatcacttccattttgggaatcttagctgtcatccatatctgaaatggatctggaagggtcttttcactgctaagactaaagctatctgggctcacatcccaagtggagcacaactcactgaagaaacacacaaatggcggttaccaggttggcatttgatatggctcaattcagaaaattaaccttagtaaattaaactgcttctatgggatctactttggaacgattctttagttagccaaggggttgctcctttgggttacagcagggtttctcaactcgggtactactgacatttggggctcgataattatttattgtaggggtctgtcctgtgcaatgtaggctgtttagcagcatctctggcctctacccacttgaagccaggagcacaaccagcctgaccctactggttatgacaaccaaaaatgtctccagacttggccacgtgtcctctgtggagaaaacagttcccagctgagaaccacggggttaggcaaatgcaaaattcatctggtgcataatactttgtaatttccacatacactgctttcttccaaggtagaagcacattagatatcaaaggaccctttgtatgcagaagtgatgcaccaggaaaggaggcctctgatgagaagagaatcccaaactcactgtcatagcagtcagaacattattttgaaatttcaaataacatttaagggataggaatttcttttgcatttgctgagttttggaaaggttgagaaattgagagagaggatattaaattacccagaaaactctttctttacaaaacacactatattaagaaacagggatttttagcaattgaaacctattattgtgaggatatagtataatattaacaataataatagcagtgccacttactgagagcttgctatattccaggtacctctgctaagcatttaagactcacaatcccacttgtagtaaaaaaggattatctctatttcacagacaagaagactgtggttgagaaaagtcaaagaacttccttaaagactatatagggttattcttctcaatttccaatcatatattcataattacatattttccaataatatgtacatatgttcacaaatcataaattgtgtttgctaccatttgatgttctgtttgctgttgagataggatcttgctattgcccaggctggaaagcagtattgtgatcaaggctcactgcagcctcaaactcccaggctcatgcaatcgtcccacctcagcctccccagtagcagggactacaggtatgtgccaccaagccctgctaactttttttttttccatagagacagggtctcactatgttgcccaggctgatcttgaattcctgggctcaagtgaccctcccatcttggcctcccaaagtgctgggattatagccatgagccactgcacatggccttgatgagtgttttaaatctcaagtatttaatatactaaacaagaattcagtataacaggttaatacaccacttcacactgatcttagaggtaaaggataatttacatctaatgctgtggacaccgacctattgatatataaatattaagtagggaggtgataactacagtcttatcactggctgacacagcttgtcatggtcccttgcagaactagttaaaaggcatattacaatctattcaaagaaacctgcaaaagtagagggataaaaacaataaagcaaagtaaactagaggcaaaatttataataatgaattccatagcactatagtagcagttgtgacaattgtagactcagtgcttaattgtttttggcaaccagacactacaagagcacagaaaacaaatccacaggaaaagtaaaaaacctaacttaatggaagaatttcaaacttaatctctaacaaacctagacatgtttacaagggctgaaaccagctgactttcttgaaatcctcgttacttatctcagagaggtgctaatgttaatgtaaatggtttaaagtcacagtaagaagcaacagtgaaaacacattggataattagtgcctgaaatagttaggacttaattcctggctactatacatttctactcacttctagcaaaaggaaaactgaaaacagtatatttcgtggccatttgtggttattcatgttgtctgctttatggtgtgtggactacctcaaacaggttctttgctgaactacaaaaacaaaagtcttccagatagagatcacacattagcctctcctgatcctgtggaattgaagtgacagcaccaggcaagcaaagcaaaccagctgctgctcctgccaatgacaggaaatagccccattctctctgggcctggaggggctggcatgaataacagctctctcaccttttcagcagaaacgagacatgaaattgctcctttccaggctaatcacaaagtgaatggcagtgtgctccttgagtgactcaccgatgatttttgaacgcctttttgtgcatgtgcatgccatgtacacacacatgttccggcacaaatcctaacactgtctgaccttgctatcggtagtgaggatgccttttccatctagttcttctcatattcactcagtctgagtgagaggctcttcaacatttttcacctacaggacctaaaggatgatgtggtggggcacagagggagaatgaatacccgctggccacactctggttgtgtcataccctctggtttcacctggtttctcatctgtatacatgaggattaataacacttcactgtagggcttattataaggattagaaataatatatgtcacttggtgcagcgacttagtaaatggcagcagttgttaatgaaaattataattttgttagtttggttctaacagtagtcttagtgtacctaggtaaggttctaggatattagtatcatttttcttttttttgtttttttcagacagagtctcgttctgtcaccaggctcgagtgcagtggcgcgatctcagctcactgcaacctctgcctcccaggttcaagcgattctcctgcctcagcctcctgagtagctgggattacagatatgcaccgccacgcccagctaatttttgtatttttagcagagacagggtttcaccatgttggccaggatggtctcaatctcctgacctcatgatccacccacctcggcctcccaaagtgctgggattacaggcatgagccacgcgcttggcctagtatttttcatactatattcaatcacctctttatttaaaaaaaaaaacaaaaaacaaaacacaaaaaacaccgctccatataaacttctagcctattggtttgaaaatggaaatctatgtccatattataatatggacatttcccccttcaaaaatgaaaagttaaagactgtgggtttaccaataggccattccagctctcagattctgatattttttgagcaagaatctctcgtttctgttgttttctgtgtattgcttggttgttaggtacactgctttgtatattatcccatgttgcttatgctctgaaattaccatcatgcattgtaattacaaaagctgagctggaacatcaagtactagtatcacgagttctttttaaaacttgaaagttttaaagagatttaaaatagctaactgatttatcagcaaggctgctggctacaaaccagagtgctgaattctgatggagcagttctctgtggcaaaggcttttgactggcggccactagcttggggtctactgacaggctactactatagtccatcttagcacccacaaacaaaagaaaatggagccaaatataactaccaactagttcaatgccctcaatacacagatgaaggagggacggtgcagagtcagcttgccaacgctgagtcagcagttacaaggaccttttcgctaagataccacatatgtatctcagacgcagtaagatactacactttgggataatcctcgaaatgttggaactgaaattcaggccccagtgctatgctattcccacagttctcttcctctctaggactgaggagttcagtgccccaacccagctttttaatacccagggataacctttgctttagggtccatgtaaaagggagatccaggtcttgggtctttcttccctttgattcagtcaccgtgggttccctagcgatagctcagccctgcagaaagacctgctaaggtacctggcctgcagtgtctttgttaccatggctattgccctccattcacaagtgtgacatcactgccttctgacttgtcctggaggaagtggctgtaggaaccaaaaccagtgtgggctaggggttgtgttccctcacctttccactgtcagtagtgaaggttcttgttatagccactttttaaaattgagacagagtctcactctgtcgcccaggctgtagtgcagtggcgtgatctctgctcactgcaacgcctgcctcctgggttcaagagattattctgcctcggcctcctgagtagctggaattacaggcacgtgccaccatgtccggctaatttttgtatttttagtagagatggggttttaccatgttggccaggctggtctcaaactctggatctcaggtgatctgcctgccttggcctcccaaagtgctgggattacaggcctagtcatagccacttaataatagcaggactttgggcaaatttcagtaaatgggtatttgaactataatgtcttcaatgtgagttctaatttaactttgctatggtcccacaattcctcttggtgggtaaaagttcgactctcctaggttaaacgcgattcataatatgtaatattttgacttaaaggaagaagctttataatgctctacaaccttgactggctaaccaaaagcaatgtaagtgacagcactacagcaaaccccacatcctggccaattagacggctagcagcctcaaccattcggaacacagctgtgaaccagaagtaggcaactgcaagaaaactccattcacttagctcctaaggagatatacagcattagcctctattcttttttcagggcaattaagataaaatgagggaaagagatttaaaatgtaggttttcctggagcagaaactcttttggggattgctcattggttaaagaattgtggaacaggagggcaatgtgaatggaagaaactaataagctgctactttagaacaatgttcttttcactcccccaccccaacccctctacttcacacagtaaatgcctaggaaagcagattaactccttctggtcaatctgaccaggattgggttttcagacaattacttctcgcatctaaaacaagaaatgcaccgattcccgaagacccaatcctctctctggctagtctttcccggagtgaggtgactcacactttttggtcagaaatgcatttattaaaaaccaagcagtctcctgttgtcccacatccttccttgttattgcatcctccctccctccctgcctcagcctagaaactgcagccaggtctccaggaatcccagccagtggctgagacttgcactgaggtttctttcagaagtgtggtctttaaatccacggccaatgaattaaatggacatttaatgataaacaatggctatattgtttattccagccatctccatgaaagaaaacaaaactcccttaaaaattgaatatattatttaggaaaatccattttacatttgtctctataatgtattggatgtattatattacaaaattccaagaagcctttaaaaagacttctgtgtttgtcctttgtcttctgtgtcaatgagggaaaaaaatgaattaattgcttctttgaatccttaaggatatatattctctcctgccttagaaaaacaagacaagatgagatctttaaatcatttgcatgagaagaactaacatcacgggtgctggctccaaagctcctgtttatattttattatgacatttgatacaactttaaagcctacctcctcctctctccttctcatcctcttcttctttcagcagcttgccaatggaattataccacttgaactgtgggtcagggatgccataaacactacagttaatcaaggcactgttcccttccttgactatgatatggtcagttctggcaatgattacgggcacagagcccaagaccacgttagtgccatttaaagtgctgttagtcacactcttagcggtggctagagtggatactaggattaaaaagggcacagaaggtagaaagcacacagtcagatggctcttcaatcgatccatcttctttgcttgctctgtaaggcaatagagagatggtttgccaaccgaatcttctatcagacaacacactgttcacagcaggtcatgggacaaacctgtcctgggtccatagagttggtacttgagcaagaacctgtttttaagaaaacaaaaatatatacacataaacattagcattcatccattcaaaacactataaacggttagcaatgcagctaaaatacaaacatcaacatactttttttttttttttgagagggagtcttgctctgttgcccaggctagagtgcagtggggcgatcttggctcactgcaaccttcacctcctaggtttaagtgattctcctgcctcagcctaccaagtagctgggattacaggcacccaccaacatgtctggctaatttttgtatttttagtagagatgaggtttcaccgtgttggccaggctggtctcgaactcctgacctcaggtgatccacccacctcggcctctcaaagtgctgggattacaggcgtgagccaccgcacccggccaaacctacatactttttaaacaaaacacaaccataagatgttccggatgtgaattatatttttcacagaaatcataattttgttttttgctatcaaaacatatagattttataggaacaaatatttcttatattaaatttatatattgcttcatagagcgcaaaaatggattcaggctgctttcacttaccatgacaagctctctttcctccacattacctgtcttcattgtggaggacctaattgttcacctgggtgttccttaacctcttctctcccagtaaacgggacttccagtctgcgtcactggtcacagcttgggctctgccggcatttggaaggactgcatcagaatcactctggcattctcctaactacccattatagcttccagaatgctccttactgtctcattcaacttcccatgctcctctgagctccacctcatctagcgctctctgctctgtgttactgttacttacgggctccaggtcactcatgtacaccctggtttcaatctcatctgcctcccacaggctggggaacatcaccagacattacggttggcggcacttctatgtccaaagatctaaccttcacctagtcctctatcctccatttcattctaattctatagccatgccttcttcaaaggcagaagttattatttcaattctgcctacaacaacactgaaggggtacctggtgatgataaattagcttcagatcatattttttttcagtaggaaagaaaagagttttgttttgccatagatttccataaaccccactaaactggagtgctttcctgccctaggaagccaacacattacgccaccagctgaaaccctgtggcgaagggagatagcacagactgcaatggcatgatagacaccctgccatgactttgcaaatgtctttctttacttggctaaacttgtggtttcctttgtggttggaaagctgacctattcgatacagaatagctgtgaagagcatggcctcaggtttgagagagaccaggccaggattctggacataaccaccttcgctggctgtgtgtcttgggcaagtacaagacaattataaggattcacaatcaaatgtataccaaacacctatgtactgctgccttgataaacaagaattattagcacaatgtataaagcatcctttattgaaatgatgcttctccaatctatttttatgtcttctaaaagccagatcttgagttttgcttaaaacgttattataaattataaataattataaatgactttcagcactgggtcctttgcaggggctcaagtctgagaatgcatgagctgcccccttaggtgtattctgtggtgagcatgttgagggcaggggctgggtcactcattattgactccctggtgcccgagccatagcagatgcctggctaaataccacaggggagaatcagagacaaggcaggttgggagatgggttctaataaatatgggtggtaaatataacttttccccccagttaaagaaaatgccacaaatggaaaatcaaactgaattttaaagtgtgtatctcaagagctgttttcaaacagaggctctccacatttggctttctacgttcaaacacattgtgctagcagagtaaagagaaggggatactgctgtgctattatattttaataatgtcagtaggtgctttgggctagaaacacagccaactgttctgaaatggaatctagttccgttagagaccttacgagatacagaagcagagactttcgttttatgcagggatttcagttagcaaaatgttttccctcttcctcatttttattcccatcctctcccatctggaaaagtcactaaggtacagaagacataacgcatcatttacaggttgtttgtatcacagcgttttgctctaaaattctgtgaaaactgattcaaagtaagcactgaattaacactaatgaattaatagttttagtaagaatttactttcaatttactctttcacttcagatttttcaaaaggtatttattatgtgccgggcacactgccaggatttaggggatgggaagtgccacaaagctcaataaaccacagaccatgtccactcacagtctagtagtggaaagacatacagataacttcaatatgttctctaggtgctatgggcttggagttgggtaggaaggaggggcaccgaacagcttgggtgccacctagagatgatgtttgttgactgcccatccagcatccaggccctcttctgcctttccctttctgtgagtcccatggctcacagggtagaaacttctagtccttctcatcaccccatcgcatgtgcacctaccaaacttgacactgctccctggtgtatgatcttgcacttttctgttttgagtaaattccttctcgattacaaggacagctcctggatagcaaaaacttgcacatatagttcagtaggatttccttattgctaggcacccataatcacgtttacacacttgctgtatgaagccatgcttatatggaatccaacggcaattatttaagaacaaattacaatgtgttgcctgaagaacataagatatcacgtgactctggacgctggcaaaatattctgcaaatgtaccttttcagcttgttggattaggatcttacagacagcaccatgaaaagtttagttgagctggacatggtggctcacgcctgtaatcctagcactttgggaggctgacgcaggcggatcacgaggtcaggagttcgagaccagcctggccaatatggtgaaaccccatctctactaaaaatacaaaaattagccgggcgtggtggtgtgctcctgtagtcccagctactcaggaggctggggcaggagaatcacttgaacccaggaggcggaggttacagtgagccgagatggcatcactgcactccagcctgggcgacagagcaagacgctgtctcaaaaaaaaaaaaaaaaaaaagtttagttgataacaatctaacattgtgaaagacatttgagccagcaaagagtaaaataacaatctaacattgtgaaagggatttgagccagcaaagagtaaaccctaagtactataatccagcagcttaaaatgcagtccttcaaaatacaagaacaaagaccacagctttcaaaaccagggcttaacaaaagctacaatggacaagttgttaaacctcataatctttgggaaaactttgatagactactttattttctataaatagaacaaaagagaaatatttagcaaatatcaaatgttctttattttgaccccttccctacctcccagccattggattttatctaaaaatgtttaataaaatgctttgttcagtcctatttcttctttttccacctataatcaataagactgttgcccatgtatttctggagctagaaggaaaaggacctcttgtgtaaggggtgttttgtactaaatgaatattattgttttttcttggcagagtcaatttgggtattgccccaactactctgatgaataatttgtagagtgatacaactggattttgttgcaacacctactgagagttacccctattttaatttgcgtgggaatgatgccacaggcacataagctaccttctggatgaaaacacattcttcacagggttatactcatgaagcatggagagggaagccccatttcatatgaattggaaagtggcactaaaatactcattaagacatgaatactaacttttcaaaactggtagtcaactcaagccatttcagttatgaatatgtttctgccacttcctttcccatatatcataatgaattcaaaatatccacgtcttttttaaacaaaaattaaaaatattttcttttgcgattaaaaaaaatgagaacaaaattctcactggctcattctatcccacctaacacctttcaggatcagcatagagtctcttgaacagcatgggtctgaaccactcagtccacttacatgcaggttttttcttttttaacagaagttacactgagtgtgcctgcctctccttccccctcttccacatccaccacctatgagacagcaagaccagcccctccccctcctcctcagtctactcaacttgaagatggcgaggctgaagacatttacgatgatccacttccccttagtgaacggcaaatatattttctccttcttaagattttcttaataacagtcttttctctagcttactttattgtaggaaaatggtatataatacacatagcatacaaaatatgtgttaatgagctgttcatgtcatcagaaaggcttctggtcaacaaccggctattagtagttaagttctggggagtcaaaaattatacacagatttcccactgcattgcgggggggtgggtgcccctaacccatgttgttcaagcatcaactatactgaattttagataattagggtgatctctgaatataaactatggtgatatggtttggctgtgttcccacccaaatctcaccttgaattgtaataaaccccatgtgtcaagggtggggccaagtggagataattgaatcatgggggtggtttccaccatattgttcttgtggtagtaagtctcacgagatctaacggttttataaatgggagttctcctgcacaagctcttttcttgcctgctgccgtgtaagacatgcctttgcttctcctttgccttccaccatgattctgaggcctccccagccatgtggaactgtgaatcaattagacttctttgctttataaattacccagtctcaggtatgtctttattagcagcatgaaaacaaacagacgcatatgggaatctaaagtcaagggccaagaaatctgtggaaaaaaaatgttcctttagcaattactgcagtccagagtcaaatcatttaagtgataaatcagttaagtcctatctcaatgcccaaagtcctattacagagattcatactgccctttcttgccctttcttgtccatgttctagagtctatttctgtacagagattcttgatgcctctaatcacacaaaggtaatacctaattcagatggcaaatgtgataatcacaggaaagtatgaaagggcattgcttttaggttagttttagaagcatctaaaggggatcagttcaatccaaattgatatgcattacctgagaaatgacctgcgctgggtgcactgccaggggttgaggccttccccctcttgtcagaatccggaaggggacacaggactctcccctcttgtcagaatccggcaggggacacaggaacatatatcgacagttacaggacagtgtgacagctgcccatcacagggtgtcaaagatccactggggcaccagacaagagatggaagtattaatagtttggatgagccaggaagaattttctggaagtgattctttaaagaagtacccaagtggaccaggggagagaagctgacccaaaagaggaatagaatattgaaagaaacgattacagagaacctggggaaatgtctgtaattaggcactgatggccaggtggtgtgtgcaagaacagaggagggggaagtaggttggaaaggcaggctggcccagaaaatgaccggatagtatgcaacgccaaggatgggggcactcacaggttttgaaaaggagaagtgacagggctagttctgtgtttacaaagatcagcttgatcctcatatggctgcgatgtagacctggctaggagactagtattatacaatatccaggaaggaaatgaacgggggcctgaaccaaaagcagtggggaaggaaagaagttggcagatgcaaagaggtacaggaattagaatgtacagaatgactatctgatagcaggttgaagtagtacaagacctcctgaccagtggcacctatgattataaagacagctcttaggaagcaagtgtctcatttactaaaaaccaatggctggcactgtcagtagaatacacaaattaagaaattcaacaaaccactcccttgggcagcactctgcactctgctgccactcttggatgagggcctgtctgctagcagtgacctggcagagtacacggtcgctcctgcctggttcctcactgctcctcctagcttcaccatcttctctctctgtacccctggctgatggagggtgttgtgatgacaaaccacagtcatgacatttacatataaaaactcacaaattaagagctatacagcagcacaccatgagaagaattagagcctgtctttttaaagtagttggcccttaggaggaaagtgagactcaggagagacctcatggcattcttggtacaatacgcacttattaattgtgtagtgttaggataatttccagctacttaatgggtagaactaaatatacacccagacttgctggattgctgtgaacagccaccagatgagctgtttaagcccatggaacaactgagaggggtaccacattattactccaactacactaatgttcggcctctacagaattttattttatgctgttattttttttttgatacacagaaggcacgtactttttcaaaaactgatctgggttaaatcactgtttttcaaacttaaaaacaaactataggcccagagatgccatcttcataaaactttatttttaatggggcataatattaagaaactattcttgaatctccacactttgttcacatggtatgtttttctgattaaaagtaaaaataatacaaaataaagctctcagaaatatactgtttaaattgcccagggtcatcaaatcattattttaaaaaatcactctaatatggagatgagatactgttgatatcctactaaacataaatgttggttaagcctgatcatcagaagggagatactcaagggacctttactacagtcttttaaagagaaaaagaaccacaaacccttataaaggaggagggaaaaaattacattaaaggttgttctctatagatatataattatcaagcaagataaaaacaggtctacacatctcttctcagaactagaacattagacttggaaaaacttggatgtattttcataaaggtttttctttactctaaaaaatggaggcctagagaaggtatggtattgcatacggtcatgcaattaatttagtggcttagaaaaaaaataaaaagaccatgactgctaataataacctcagatcagacctgggattgttttcttggttccataaagccaattattaaattgttctagcacttgaaacatgcagtgcaggctattctaatcacaggtatatcatttagaagagtttattgatgtttgagcacataatgtcaaattcttattcttattcattcattcatatattaagatagcatctcactgttacccaggctggagtgcagtggcaccaccatggctcatcgtattaattgggtcattcttaattgatcagagagacatttctccagaaatctgatgatccaaggaattagccaaatctggaaactgaatagaaatgggacagacacactgatgcaggggcctttatgctgccaggccaatccctaaaacggatcacaatgcacatcagagggttacaatgctgtattcacatttttctttgatctttgacaccgtccttattagagtctatattcaacctaagctggtacagaagcatctctagctgctgtctttcttttcattagaatattgttccaacatctcccccctttaaaaaattatgtcctttcaaaacattcttcctactcatttggagtatgcatgtagagattcgaattttcattctagtccagtgaatttatgtcacctgctaatctgtagatggcactacttctgccagctttcaattgtttttatttgatctcaagcccattttccaagaagttcctgatgtatttagtgtgaagctcctacattcagagtgaaaccaggcaggagctgatggatgtctggaagcctggacacatcagtgagtcagaactcttttttggctagaaaaatggctagaagatgccatgtatcagggaggtgctttatggaggtgctgatccctggctgcctgcccacaagtccaggctgtgcgcgctctgcctggatggaggaagcaaaccctgccctctctgcagcccacagagcacattgtctataaatcagagggcaatcttcttaatatgctttcctaatatgactcaggacctgaaataattgtgagtttacattttcttgctaattctggatcgtttgcaaacccgcaaggccttgataatgaaagagcccttctcaattcctacctctccctcacatttgattgtgcacacacagcttcccaactggccaaacaaaactcccttttctggaactgggagggtaatttcacatacaatcttacaaagggtggttaattattttgtggtgggacagctcataataaagctactcaactcacgatgagcctgaaggatagtattaatagtacccaactgagacacagaataacttctaacagaaacacatcgagtgttcttagcaacagccagtgtgaagaattcactgcaggtctcctgcagccgtggagctgagattttaatacagcaaatggataggatcaggtgcctgggataagagatgggttgggctctgaggttaaggtcaagaacagaaattctggggtgatgtgtgaagagcagatgagtttagaattttaggattaagacccacaagctgggagtgaggatacttactcctttcctccattttttatttactaggagatgacgcctgggagtcagttgatctctccgagcttcagacccatctcttaggtcctttccaaatctatcatagtatgatcatgacaaccaggagtaagactggggttggaaaagggaagaaacggtgaggggtaaagagaaaagggaaagaacaagagagttcttggtgcactgctaaaaattccattgcagtaaatacaactggggcaaagcactgtgatggccaagccatttgtgacttggcagatggccacagacacagcttgtgcgccacgcagcctgtgagaacttgttctccataggcaagacaacttcttgtgtgtcccttacattctggacaataaaatgagggagtaaatggattcaagctctgaaagtattaggacgccccccattcataccctctccagatgccctcatctcactgcagatgtgaatcagcccagattcctccaggacttcctatatggaagacgggccggtcctcttgggcacagctgcaggtttctccctccaacttcaccaccagagcaggctggagtgaagcctgagcctcactacttttaccctgttacctggactaagagtgggtggtgaacttagtgcctgtagccatgccacggacccaacctttcctcttcagaccaagaactgctggttgtgtaaatccgagctgttccacagggggtctgaccaaggcccgtgtctttgggccttgaaaccttcatttcacttgataattcagagaggccttgagtctactatggcaatttgggaatgtaatttttatcattaacataattgtcccattaaaaaaaagagttggtattcaaatattgttgattgtgcttagcaccatgcattcattacttttattattatttaatgattagtaacaatctgtgcatggagaatgtctcaaaatataatgaatataaaacgctaagattcttaaattattataatgtacatttttccagcagttcgtcattcagtgtaaaagccagaggcagccttgctatggcctgacagtaggcctctgacagattcacagcctccatatccaacctcactacgctcgctcaatccccatcagcctccctgggctctgctaatcctgaaatgggtaaaccccggcatccttgaacttactattcccaccatctgaaatgagttctgggatacctggaacatttcctttggaaccctcaggccttcaaccagcgaggcccttcctggtcacctatgtgaaaccgtgcccaccccatcatgctctacctacctcgaccctgcctttgtctttacagcattaactactacgtgtttacatactgcgctcccattaggatgggagctcctagagggctgggctcctgtcgttgccgctgtttactgatgtatccccactgttcagaaacacactttgctcaaagcaaacacttgaatatctgcggagtgaatttattctacttatatgccctctaagatagacctattactaacttactgctcgcctttggtacaaattcatttcttagacagttctggaaaatgtctgttctttaaccacagaactaagtataacccaaaatttctttaagtcagtcctcagaaatgcatcatttgcttacagtggaatttgagaggctggtgataaagacaggcctgtgaacagaggctcagggtaacacagaagacgaggcggagatgccagaaatgtatgctcttgttattgttgaagtgaaaagcaatcacctacttaatttatatttcaaaatgtcgcacagtccctcattcctgtgtctgtggttgtttgattaagaccattcaaattcacagcgtaggaactagatcacctagggtttcctctttcatcaggataaaatttcatctgtttgaaaagatgcactcaataactggagagggtagttaaatagcatttcctccttcctctttaccagcccattatcacaaactggaattgcatcgtgaacacttccctgaatctcccacataaagtgtcattataggctctttcactaagaactggatctcggtgaaaaacagatcagaagagatcctgtaattcaaaccctactggatttaattcttaagagtgctatgataactaactccccttacaattcacctagcatttatggtttacaaaacacccccacagatgttatctcatcagagcctcagcaccactctaaggctgggacaggcctgtgattctgcccacacaacagcgtaagaatctggggccaagccaccaacactgcaggaaaagtcccttgcagagctcacatcttctctcagtccagggctcctgttacctgcacacggtggtcactgagtgcccaccaaagcttcagcaaccctcataacattgtagctaattattttaaaattttgttcataaaagcaatatttttcagaattttattccatcttaataatcttcctgactttagtggttaagatcagtcttccacctaagtgtttttcagtgtcacaacacggcaaattgttgcaattaaacaaaatcaccagaagaaagctgaaaatagggattcagtggtttccactttgcttttctctcagctttgatggaaaggggccctgttaggctgagcacactttccaggtgatctctcccatctctccgctgggtagtcacctttatctaagtgataaacacaattaggagccagtcatatcaattaaataaactgaaagtacttatgaggccactattatccacttagtaccaattactatggggattaaaaacagtttaagaccaggcctttaccccaaaggtgcttagaatcttggtgacacctgcatacaaagcaatatgcaattatgggctaaactaggtaaatgccacagaaattcagaggaggccaagctgggaaggtaacagaatgttccctggggttggccaagacctgaaggatgaataaaaggagaccagacagttctcctagcaggagtaatggtttagtctagacaaataagggtagaaagaaacacggcacgcaagtaataaaaacctaggtggcattggtttttgcaagcatcatgcagtggatctgctgtgcaaggctgtctggagagctctgggacagcagggaactccttcagaaattctattccagatgagggcctctggggcatcttaggagaaatgataaagaggactttggaacatttgatccactacttaggcacaagaactaacaacccagtgaaaggaggagaggcggccataacttggaggtagtgatgagatgccttccaaaggcaagaagacatcagaagtccactgcacgtcctgggtacagaggcacaatgagaaatgaccagcctccattaaggcaaaggatggttaatactcagatgttttctggaaatgaatttcaaggtcctcaaaaatgttttgaaatggagaaaaacaggttacctttgagaagttctaaccagagctggactcaaagaccaagtaatctaggattgtccaaaccttgaagaaaaacaaaacgacaacaacaacaaaaaaacaccttcccgccaacgtagggctgccagcagaaatggcagggagtcattagacagaactgcaggcctggccgggggtggggcagtgaagcccagtgcctagctttagcggtaagcagcaattttcaagatgaacttcataacagcagctgagaagcaagaacgctcactggttactcaagagtttatgctatccacagccatcctgggcagtaaagacctaacaggaggtgctgggagccaaacactaacttagtcttcactcaaatacctttccttgcctaggaccagggaaaacgggttttgaatctttaagcacagtcgctgtttatctacctactttcttgcaggggcgtctggcctttggagaagaaaggagttggatggtctcctcagggtggtcattactgccacaaatatagagcccttgctaatttcaagaaggaacagaaaggtacagatacagcctggtgcaatggctcatgtctgtaatcccagcactttgggaggcagagtctggagatagcttgaggccaggagtttgagaccagcctgggcaacatagcaagacttcatgtctacaaaaaaattaattagctgagcatggtggcatgcacctgtaatcccagctactccagaggttgaggtaggaggatcacctgagcccaggagtttgaggctacagtgagccatgatcatgccactgtactccagcctgggcaacagagcgagacctcatctatatacacacacatatgaaaggtagagactcgagaacagatggatcctatcttgttaagaggtactgctttcgtaaaccgatgagaatgatttgaattagtctcagcctgcacctgaactgggtgggtcccagaagtggacaattctggagcactttattctaacccatttatttcctcaaggagcaaacccttcccttacgatcttcctcacaccatcagcaaactcaaatcctcagtggaaggaaggggttgggattatacttcagtatctgttcagcaagttttcctctttcctgttgactagagtcaatttcagcacagcctctaagtaagttacagtctcaatccagaattaggaaagcccaacccacaacaactttctttcagtctcattagcaagtccccaatgcttcagtccaaaagctgagggtccatcagggagttaatttcttcttttatgtatctcttacaaagtctgtgccctgtgataaggttccgacttcttccctcgcatgtggtgctgtgtgtggggctttgcagctcctccctggcctgaagtcccttttggttaagcacaggcagtggaagttagtctctctggtgctgcaaagtcttgcctttggtaggaagacccctgagagatgctcagaccccactatcctcgagacaggtgggccttccacatttctgctgtacctgagacagaatctggttcactataaagacattgtttaaaatgtcccctttccttccctgccctgagaaacatatcaatcactgagttctaatgattctcactcctcaatattgggctgccacatcctgggtttcccctgggttatgtgctcatcatctctactggactccttccttgccgacctgcctctagtcttgcctgcctccaatccacataccatgtcattactagagtcagctgactctgaaagatctaaaacatattccatgtcttcgttgtgtcaacagtgtgaaactcaagtcctacgcaggacctaggtgattcttcacagtctgactcccatccacctccctgactgcatctctggagcctccccctcccccctccctcctcccattcccctccctgactgcatctctggagcctcctcctcccatctccccaaccccagcaagttctctttcctcaactcccagtagttccccacggcaccacctccagccacgttcccttccttaccttgcacatctggcaaacccctagctttgaggtcttggttcaaaagccctccaagactcccaaggtagccccagacactccttttctcaccaccctttactcataacttcctattttcgctataattatctttttgcacatttgacccttcattagattaaaatctcaggttgtcactacctgttgaatgaattaatgaatggatggaatatgggcttgagaaaggctggacactggtgcatgggtgactgatgcagtcatgaggaaaaataagtcacccggaaagaacacagagggccacaagcaagacaagagacccgggttagaacccagggaaagcagagtacaagctctcggagaaagagcaataaaaaaaatattgggaatagctaagggcacagtattccaaaggccacagcaggtgggccctctgcacttctgtagagcctgacacagataatccaattaattacatgggagttgtttaaaatgccatctttccttccctgcccacagatagagtacaactctaccactgagtcctggtggttctcactcctaaatatctggctaccacaacctggtttttccctattaagatttaagagcgagggaatggtttacactgacctagtactttacaatagaaaacaattttttttgcatcattctatgagaacatttgggtaaaaatcttatcaagtcatacaaatggatgctagctatacaatataaagttttgttttattaggataaattttagtcaagtcttactgttgtttccagtgtcagatactgctaacccaggccttcttttaccacattgtctgaaaaatttgtttttcttacatgcagttcagtttcaattcaaagccactcttacaacactaagatagaagaatccttcagtttaggttttctggacacagagatgtcaatttaaccaagagacaacacatttttgcaaggtagatattgaggccttgtacataagagagactaaatgaatatgtttgaaaagaattactagatttctaatattcaaacccaaaagttagtttatgtagtattatagctgtcaactcccacatcccccaacaccaacgtcaaatatggagcccatcgcaaacattggtgattgattgtggcactttcccagctgaaccagtacaagcccatgacattgcaagcagctattaccaactggtcagagttggcccatgtgaaatctcatcattctcaagttaattatgttaaattttagctttcacagctccttgctcacgtgtgcatggtacgcagacagcagaacagctgattactgttagaggacaatgagcagaaacaaagtgaaatgtgacttgcctcttctgctttatgatgtccttcttattgtgagtaaaagttttaagctattaatttcatacatgcatacaaatgctgccatttcagatgaatccagagacctgaattacagcatgctggttccagacctctactggccactgaccacctcttgttggacttcctttatcaagctgccctgtgaaacctggggtttagttatccattgtgtttttaggaagtaaatctggcatcggtctgttccatttcatgttctggtttcccatattttctctataataggacagaatccaaactccttcacatgacactgagctcatcacagtaaaaggaccactttgttcccctcctcctgcccttgcctattagtccattgcaccaaacctttcagtggatatggctgtatttgctttccatggttcctgtaacagatttccacagactgagggatttaacataaatttattttgcagttctggggcacggaagttcaaacaggtcttaacgagccatcattcaggtgggcccaatgtaatcacaaaggttctttcacgtgaaagagggaagcagaagtcagcgtcagagtgatgccccaagagaaagattggactggccgctctgagctttgaagacggatggggctacaaaacaaggaatgggggtggcctctagaaggtggcaaaggcaaagaaacagattctcccctagggcttcccaaaggaacaaggccctgcagagtctctgacttttgcccactaagacccacgttgaactcccacaccacagaagtgcattgggcccacctgtataatcctgaataacctccccatggcaagacccttaactcaatcacatctgccaagttccaaagtggacacctttggtggggggcattattctgcctatcccaatgatgttccttcttcctggagtgtctactctgcttagaagacttctaattctttgggcattccttaatgaaatatcatgacttttcccatggaaatgtcactccaagcatgaggtcctctcctcctccaatctacggggttcatttccccgcctcctcagtcccatgtgcatccctctctggagcactcatcctgtactgtgttttatttgtcctcaagcatatctccctgactcgactgtgacttactcttactcatttttgtggcctcaggagtctaactataaaagtttgtggaaaaaaaaaatgtgatattttaatgagtaaagacctcaggtggaagcagaggcaagaccaatacattcacaggacttctgtttggagcataacttataaactacttctgatagctcttaagtggttacaccatgacataatcaaccaaaccctttgtaaccatctttcaaccatgccagggaggtattataccaaacttaaaattaaccactggcattttaaggccatttctaaccgcaatgtgatatgccatagattgaaaacattgtcaaagttttaagtgtcctcctggccttggctaggaaagacaagtcacaccctaagtgctgggttagatgccaacttaggggagtgatagtatctgcatgatttctaaattccaaaaactaacacttgtttaacaaatctggctaggctgtgttgaggttaaaagcaacttggctacaatatttatttgtattccagtatctaaaagttcttgcattaaaaagtagaataaaaagtccaaattaagcacaatttaaaatgcctcgagtatttaaattgcaagccaaataggaattggataaattaaggtcacagggattgggggatagatctatttttaaagggagtaatttgctgtaaatgtctaatgtcaccaacaacatcatacagtctagaaatctaaacacatggaaataaacctaaaaatcacgtgcctagcaagtgagctgcaagaacccaatagttaactacaaaagagaagaaatgatcacctttttttgtaacatgcctacaaagtctatttttttcttcatgagcagtaataaaaccccttttcaacctaactcctgttgtttttttgagttttaggttagggaaatgtggactttttgaagccaagggcagtatgtaagtaagtctttgattaaatttcatcgtgtctcttaacactgagaaaatacttaggatttgtacttaggatttgtggatcgagaagggggcctattgatctgtattaaacctcacattcacaaaaagtaaactgaggccttgctgcttcctccaggtcaggaagaacccaaggctaaggggagactctagctacttctactggggaatgtcacctgaggatatgagacctgctgttcaggataaggtgtacatgcaggcagtacttcatgaaagattttaaacttgatgcatttttatagaaaagagaagcacaattattcaatatttgtgttggagttttcaaacttatttttctataaatgtatttagaaataaatttaggatgagtgaacatcaccaaccagactatttggctaaaatgggggactgcaggttctaattcataaaaatggtaatcatgttgttgctactgctgttgtctggatgtttcaagcctttcctattattaaacctcggttatgcagcatcacaggacagagccaactctatactgggggaaatcaccccagagagtatccagaattagagctggagccatctcaggcttgcaagcaagcaccaaccttaaagcctacccacaactcaatgaaaagtcaatgcatttctaaagtctattaaggtctataaagaatgtaaacaattgttttgtaataagcttaatgaataaaacaactgaacccactaagtggtacttatagaaaagaggcttgagaatttagctttagttagcagaactagttcccactagaacaggattgtttatcttgcccctattagatacaataatcctaatagtgttaatggtactaaatgttttaggaataaacaactgtagaaaccacactgggacctacaaattgcactttctgtgtaagtaaaatgtcagaagaactacactgttataacttacggtctcatgaaacgacatttttttccatcttgtatttcatcttgaaggattttactatgttcagcatagtagcaactgaaaaaaatgtgtttcatctagaaacaaaagtgagaaaactacaaaaaacactgagcttctgcaatgctcggtttccaagtttttaacattaaatcgaagataacgcaaaataaagattgccacagtaaccaaacttttctgctaagtatccttaaaaataatgacagttcgatcgtatcttaactgttttctacaatgtgagcagataatacacctacaaacctttttttgctaccttgctttataaagcttgcaagtttttttttcagggctggagaagacagcttaatgatcaagcttaaaataaatcggttctgcaatcactctgtattttaatccgatgaagcacgtttccccattccacgccatgaagcaattcgatgtcaacttgttatggagtcaaatgcgacaaactccgagagcttcagtagcgaggcggcggctcgcagcacccacagccgcccgcactcctgcggcatcaggacacggcgccctcccgacgcggaacccgcattcacgttctccggagccctggccagcgcacgctcctccctgtccgggtaaactgaggcacagcgatgagagagatccagagcccagcgaaagcccccacggctgttcggcgtccccttcccccacgacacctaggaggctcgccggcagctggcagtggattccgcgctcctcgccctcggaaggttacggttcgagcccaggatgcggcagtccccaaacggccagcccccgccccgcacggatctcgaagcatcctgcgaccccctggagcccgctgcccggaccctgcggcgtctcgcagcgcagcctccgccgcagtctcagccagcccaaacacccgaaagttcggcggccccggcgccgactcggccgccgacccggtgcggggctggctcccacccgtgcccctccgccccggcccgccgggggcccccgctaacctgacaccgccgcgccactcaggtggccgccgtgcacccctcgccatggccagcccgacagcggccgctgcgccgcactctgcgccggacgcccggtagcgcctactgcgggcgagccgcctccgccggcgcctcacagcgttgcgagctgcgccgccggctgccgggagcgcggagcttcccacctacaggagcctgggccggccggggccgagcatgcccagtgcggctcgccgggcggcgcggaggcgcgggtgtagccgccgggttttcgcggcagccgcgggcgggggcagcggggcgggcggtgcggcgcgagccagtcggtgctgcggagcggccccgcggaggagccaccggaggctgtagttgccggggagtcccgcattcagtccgctcagcctctgggccgggcctcggcggcccccagagccccacacccgcaggcccagggcctccgcggcagcgcgggactctcactccgctctctctcccgcccggggcttccaccgcaacttctgtgggcgtcgcatcgcacgcgtgttcaaggacacccaggaaaaggcttcttagggtcccatcctggggcgctaaatgggaaccagtcaacccacccccaagcctaccctgtctccttgcaatcaaatgcaatcacgagcaaaccaccttgcttccgaaagcttctcaggccttcccgggcgactgcgctgtaagtcttaaacgtctcttaaagcaaagtccacagatggaagagtctggaaaaaaacccagcgggccgttccctggtgactttctgagtggtggggttccaggaatttttttttcattttctttaaaaatattatttgtaatttccacgttttttctaatgaaccataagttgattttttaattaaaaagtagagtactctaaaattattaagtacctacagaagtttcgctacacgatcctgcaatgttagtggcttcttctcctccttatctccctttttttttttttttttttaattttaaaagagaacagagactctcaatttctggggcgggaccaggctccttcccccggctttttagtgcccgccctcttggccacaccccactccggcctttttactcccgtaccgccctcttcccggtgggttgctgcgaaaacccggaaaggtggactttccacattgacgctcccggcggctccggcagccagactgggcatgttccgccgccgggtcaggcattgctgtgccaagagaggagctttagcaactctcagtctctctgctcctctctgttcctggcaaactggcaaagtagtgcctctgaccccacgccccgaggtcggacctgcagaagtgggtcaggacccgactgagcatgctccgggcagtgccaggctgccgcacgcggctgcatctggttgcccaaggttgatgtagccgcggtctctcgtcacgacatcgaagctcgggaaacggatggaagcagggctctagagaggcacgattgcatcgacacgtgggcaggtcgcccatgccaagggccatgttggtgggtgggtgcgtgggatctgtcgtatgagtgagtcaaagcctgattttttcccccaaaaagattgaaatgagatatcatattttaacattagttttatggcatcttgaatagcaacacattttagctcaaggaatttttcagctgtccttttgagaaacgtaaattttctttgtttttaagtatttaataagcattctttacaattgcaccacagcgcgaactttccacctgctttattaattatgacatttgtgtccccactattaaaatattccgcagtattatatcccgttttcttctccagcatttctgcattcactctgactctatttcctcccctcccccatctcttttaaattctcagacaacctgcaaaatgcactcttgctatcttagaaaccacttgaggtcggtgtggggaacttgcttttaattctcatttagagaagacagtactgaaatggagaaaagtcacagggaaagtacttttacagattgtagattagtaaagaacccaaagagagcctttcattgagagcagaaaggcgaatggaattcgctgttttctgtctaaggaggaggaggatgggcaggcaggtcagctgcccagtggggcttggtgtgatagtgggagtcacccttcatttgaacctctctgccttgcccagctccagttcagcttcagcgtggtcagagacactatctctatggaaggtcactcctggaagaatacatttacttagctgcttccaccatggaatcctagcttgtgctggagtgtccccttcatcctcctcctgtgctttgagaatccattgttgctggtatgccctgagcagtgcccttgaacttgcccaggtaccccttgacatccacaccacaaatagtctagccttacaaaggtggacaagatgtcttttcaacagtctgtactgccacttccatccatctgaagctttctgttcctgagtctgtcatgacattaatctttcaaaaatctttcacagagatttttagtctctactaaaaatacaaaacaattagccaggcatagtggtgtgtgcctgtagtcccagctacttgggaggctgaggcaagagaagcgcttgaatctgggaggcagacgttgtagtgagcagagattgcgccactgcacttcagcctgagcaacagagtcagactccatctcaaaaataataaatatatatatatacacacacacacacacaaatagtatggataaagggaagacgctgacctatcagaacaactgcctgatcaaccagaaaggattccagaaatgaacacctcgcatggccatgtgagaacataccagctaacacccctttgacagcggcaatcatcagagaggatgacagctctcaggaagaagagaccacagaacacctacaatggggcggtgcaaaggatgagaatctggaggaggaggatgagaagaaacaggatgacctgcaattgctcttctgcttgtatttactagcttggttagcgggtacccgtatcttctcagtcacttacatgatgaatctgggcgttaccctagattcattcatctgcctttcccgtgtcatccagctggtctcctggcattatctatcctgtccttattcatttctgaacacctcccttccttgcctcattgcctgtcttactccagtccccatcatcttcctgatcaaccacagagcaacagactcctagatggatcctctctctgtgtcccctccaatccatcctccatagctcctcagacttttctttttaagccaattgtattacaatatgtctgctaaagatccttaagtgaattcataatgccttcaggataaggtccaaactttaagcatgaactggctgctgccttcctttccagattagtctccagcctgtgtcccctaatatcccatatcctcaccagtccaaattacctgccgtgtgaattcacacctccatatatctgttagttcttttgtctctctttctcctttcttcacctgacaaactgttgagccttggagatccagttcaggcaggatgtcctctgatcttcccaaggtgaatgcctcttgagtacttcacctgttttcatttgacacctaaccttgattgatttttctttcatctcctccgctacactgtaggcaacctgatcgcaagggctgtgtctcagccatctttgtgtcttcgttcttagtcttcaatagaattttacttaataaataaatacttaacatatggactgatataatgtttaaagtttattaatttaaaaaaaatgttgctgagaattataaacagattgcaaagaaaaaatgccagaacagtcacatcatatgcaacctgctgaatggttatgctcctaacaataagttaggagactaagataattgagctctcagatttgacctccttaagcccaatgaattttcttcagcttcagaaatcaggaagtattttgtgaaccagtctgatgtccttgttttattggtctgtaactgcatgaagcccagcactgtattactaattaacccacaaattccattgttctttatcactgtatttatttctttccacaacgtggtaataaccttctaattatgtggttactccttagaatagatttagtttatttttttctgttgaaagcatggcaccccaggagggcagactagcctttttggaattagcataattttttacagttctatcagctcataatgtctgctgggggcacctggtactaactatgggcgaactgatcaccagcttcaggatcacctggtggatgaagtttccattccagacctctggatagagtagtccaagaggcagtgatttttaacaagtcctcctggtgactctgcacactctatgtgagaaacagttctaagtcacatggataaaaggaaaaataataactcttggtcaaaaacttcaagtagcccctgtattgggttttctttggcagagagatctatgtgggtgggagaggtatctgcccattaataaaagtgttgttaatatctgtgcttcttacatagccttggcttatattagagggtctggagaacataggagagtaacccagtaaagtagctgcttgtttttgcacttgttgaacaacatagagattttgctttgtaatcgatgcaggcccaatggtactctccagtttctcctttctatattctaacccctccaacagagagtgagtggagcattggaggttttgacctcacactcttcctggaagaggacaataagaggtgtatgatgctacctacattaggctatcccttattcctgggagtttgaaacagcacaattagaaggagggttaggggaagaatgaaagaaacccagtacttctctctagtcttgtgatttgctggttgaggagagcaaggcctcttgaaaaggctgagtcaatacagtattaggaaaatattccccttcctcattctgggtttggactcagcattgacatcggtcccttggaggggtgtgcatgtgtgtgggttaagtggttatccagctggaagaatcaggagatcaaatggcatggctgcaactcacagcggcagaagacccagcgtgaagggtcgcatccttcctagacctccctctgagaccacaccaaagcccttccctcctggagagtttgcagcttgccagcttgggacactaatgaccatcacagctgagcctcccaccccaccagggtttcattttagtcagtaactcagatgtagggccatggattattggcaggagaaaggatgcatctggaactttgcctcctgtgtgtaggggtggcatttcttgaaaggtgggtggatatttgcagaggaaggttagaaaaggaatgtcttggtgagagaagtatgaaacagagccctggagactccaagtatggggatggctgagctctagaggggacccctttgtaaagaatttgacttcacagttactttacttttggattctggaaaagtcgtgacttgtatttagcttggagtttgttcttcttgttcataatttcctcaggaaggaaggaaagccagatatccactttcccactatacaatggaggatgctggagttgggtgacccagggaaacaaataagcaaggaaacaaacatcagcagtcaacatatgggaaaacaaacacgcaaagaagccaacatattctccaagaatgtggcccaccaggtgaatcctttgtccccaggcttgacagggaggctgcgccactcacctccaaatgctgcttagaagaggagggctctcaagctcaggggaggctctggcagcatcattgtgatctcagtaggaataactgtgactttgctattgcatgatgagaaatccaaatgaagctcatgaagtcgactgtaattttctaggctggtgactttcatggctctccttttttgagtagttgtttactagaattaagagagaagaaacagaattctgtattttatctttttatttatttatttatttatttttttgagacagggtctcgctctgttgcccatgctggagtgcagtggtgcaaccatggctcactgcagcctcaaactcctggactcaggcaatcctcccacctgaacaacctgagtagctggaactacaggtgcacactgtcatgcccggctaattttccaattttttgtagagatgggtgtcttgctatgttccccaggctggtctccatctcctgcctcaagtgatcctcccaccttggcctcccaaagtactcctgggattagaggcatgggctacaacatccagccttgtctttttatcttttggatagtcatgacaccaaaaatcctggtgtgggcaccgtggctcctttgagggcagaggctgaggagaagccccaagatatggccaaggccaggagggatgaggctgaggtggatggtagaggtgtacaaaggcctttgtagtggtgtctgggggacttacagagacaagaatggggagaatgagatgctggcttgacagtaggtggagcaagctggctttcatttggtaagatttgaaggaccctggaaggctaagcaggcttgctttatatgggtatctcgcttctcttcttgggacctccccactgctaagtgaggctttgctagagcatggagccagctacccaaagcctgggtcccaccgtgagaggcctcacagtggggagcccaaaggcccaggccatgtgcaagtagattgtcacaatgggaaagtgtgtttgacactaaagtctactttagatgatgtcacaattttgacttgattcaaccccagaaatgaagttcctaacaaattggaccttttttattccccatgataagaggccaaatgctgtcaccttcagtatgatgctggctctgtcttccccaaataataaatattatttctatccttcattccaggaatgattggctggtttgttttgttctcgatcatggataaatatgctcctcaatagcttttctttatttatgtattatgtggaacatatgtcataactgcagttatccagctgaggaagtaggtttctttatttggacctaatttcttaagaaattatgtttcttttatgatattcaggcatttataagctctgcagcttttctttagaagtctttttggtctaatctagtaaagtttctggcacacaagagatgccaatacattttgttgaattatctgctggaagttgcaggaagaacctcatgctggagaatcctggaggaaggcattttaaaatacaggcaaccatcagtccagttggttggtctgaaatatcattcagactttggccttaagtctatttggtattgattctgcttttctctctggtgacatgtttcagatctgttaccaacatgtttctccctgacttcagtcagccagcaaaaagacaaaattgattaatccatgatgaatgtatggccaaatgtatggatgaccttgaagcagcggctgttttttcagcatcatggtttatgggctgtctcatcataggtgggcatttcttctgctaattccaaagagtcttccttgctgctaaatccaatgaaccctccttgctgctagttccaatgagccttcctcgctgctagttccaatgagacttccttgctgctttaataggaattttaaaagcatgttgaaatgaaccatccctaacatttgaagaatgttgtcattgtgtttgtgaatgaactgggacagtttcctaaaatgaatagaaattacaacttgctgctcagaagtatggagcgtagggtaagaagggcagctaagaattgcaaataagcatattgatgtgggttagcagtgacggggagagagagaaagtggagtataaaaggaccctgcagatctctgtcaatgtgattgatttcagtgatgtatactgctgtgtgtgtatgtgcttttggcctgtagtactaattactgaaaatggactaagattaaaaagggaattgccagatgcctttaggaaacttgggctgttacatgaatattatatttaattatattaaaagtcaactatagcttattgcccataagagacaaggtaggtaatgagtttactctgagcacaactgttggttatcacttagccattaaccagcctgtgattcgcctagcgccagctccctgttctgagggcaccagaaaagcgggagaaccaaagacagctctaaaaaggtcagtattacaaaagagtaccaaaattgtcatcacaggacaatcatgttcctccaccctgccttacactcattttacagcttggacttgtttgtgcattgactgcctacttgttttggtacttggaagcttcaggttctaaatgtcttaatctggttttctgtctctacctcttgtttttgctcacatttactctctgctacttatttttcttgagagcattatttgccctctttcataatgttatgggaagacttatgggaaaatgaggaaccaaaaccatttctagaagcatccaaaagacttctcagatgtaagccacgttgtagcctccaacggccttcctgtcagcctgacttccaggacagttttcaaaggctacaggcataaatggttgattatttcctataagacgctggctcaggcataggtttgctttaaatagcagttgttgtctaacctaaggcattagacataagatatgatacacaagtcaggaacacataagttacataattcaaggatctctggctctttgactcaccatgaatataccattagtttatctgtgagatcaacctacatttaagtgttaatgtaggttgcatttaagtgttaagaaaccaatattgtctgcttcaaagaggctgctgtatttccaactcccttttaaggtgtccttgcttaacctcctcagcttcccctaaagttcctctgcctctggctccatcagggtctcacttcctgaaggagaaggccatggtctgagtatacctttctgtaagcagtgcctgggggcccagaagctgagaagcagcccaggaggatggagacctactcagtgctcaaggtcacctttggtcaggagtgtcctaccctgcttcatgtaccagccacttcctggcccctgtccttggtcaccagggttgaggatgatggaagaatgtggtgatcattcaccactgcccttagctacccaatggcctcccagcccttcctgatggcagaagaggttgaagcctggggttggggctgaaaggactcttccactgtcctcttcttgtccctgcttccccaagcatgggctgcgggcttgctagtttcttgccagtttcttcaggcactgttacacctgccccagttttattcaagataccttgggtgttatggatgacccctggggatttcctcagaatcccctaaaatctagtccacctgtcagaattgcagctctgtctggggttgcagtaagagcaagcagttgcttgaaagaggcctgggggtgggaccatggaatgacaagaaacagaatttaagaagcaggtaggtatgtcttcattttatactcttgtcaaccgagtgtaactttttaatggaatcagtatatttaatataaacaaatgcatattgattgttttggggagagagtgtttttcatttgttgcattaactctcagactgtatcattctagacattaagatgactacacatcaccaccgtgtcactgaagtggtaaattgggaaatattgtatgagcttcagtacgatttgctcttaatgtcaccatgagaaattagccatatgattcatgcattttagaatggattagattcaatatttcagaccagtgaaacaagtattgtgaataagtggggaaatctagtccattgcctacattttaattcattataaaataaataggccagatttgtctaacagtttaggaacactgcataattggtagtgacagttcatttacgaaagaactagaatgtctttttttttaagccataaaataaattggacagtgactcttatcccatgatttatttatggtggaagattaataaaaacattaagcatgatgaatgtattttcagtgacaggattacagcaaaaaaaaaaaatactagcaacaataaaaataaaatgaattttacatttttaatcagtctgaagaattttgctgcacaacaaaataagtgatattatttttatcactcacattaaaattgttttattatgcaaactctattgacgtgcattgcccatcttcccaaactagggctaaagccccttgagaacaaaggactcatctcatgttcttgcatctgttgtatcctggtattgtcctacacataaaggtattgctgagtgcctgttaatgaaaacataaacttactattgatttataattatacagttttcaaataaactcttctatattaggaactagatatgtgaaagaaaggcaatgatttcattttgagtagctgttcacctaaaaagaaaaaagaaaagattatttggttagaagccagttggtattcacggaagtggctttctcatggaggtttaggttccaaagttagtacatcgtaaaaatgaatctagaaaatcccttacactgaccataaaatttaacatatgtttgagtgtataatctatgcagtaattcttctgcacacaaaaacttccaaaatgagggataaaaggaaagtccctatgccaatgtctgggtgacaatcagagccatgtgtcttgaagggatttgtcaaattgccaggtgagtggaggctagggtgagatgtccaaggggctcctgcttgcccacaggatttactccattcagccttaatattaagccttgatggctttaatatgtatcactatgaggattaaacctgataaggagtcaccttttctgtatgttatggagggaagggccagatgctgaagtcagggagcccactgcccttttatcttatgaatatggttttatctgatgtgaaaggagactggagattcatggcagttttcggattcaattccatcctttcgcagttgctagagcttcgtgctttagccatcctggagtggggtttgcttagagaagttttgatccagtaaagaattgcttgatgaagtcctgtttggttggttactgctctcagatcatgatgaactacagtgtgacagtaaaaccagaatatcgtttatgtttgaaatttaatttcacattattctgggttttaggaagactttgcccaaccatcttaagatggtcacaggggagactgcataaggcatagtgcactagtgcagtgtgtcaccatgattgggaaaaatatgcaaaatctggtgagcagtctaaagtccattatgcatccaaagttcatcattaactgtttttgggcaaagatgtagtatttctgtccattgctgtgagcctgctgtacatttctcagcctttcttttaatgagatccttactaatttaaggcctatccagggccttgtttgtaacttgtttgtaactcagggcatgaagaacctgtatggtcaaagctggtgcaagatttatcctgaaacaatggtttagttgccaggaatgctgacttaagttcgagctccaaatattagcaaccatcatgacctgactgagcaatgagatttattcctgaaaattctatgaagagcttcagctccaaatggtttcctgggggtcacaagagcactttcatttgccacactgttgagcaaaaacgaagtgatggagagcatgattctatgggctccataaatttttgtgctcttctcattttaatttcacttcatacctccaacctagagtgcagtgtaataaacccctttccaatgggctggcattacatggaggcagagtagctgcccccccggcacacgctgaattactcaggagtaggagtctctgcagacggctctccagccagcatccttggccagcctgcaatgcatccttctttcctcccacctgtgtgttcccaccttttgagttgccacctcatttccacaatgaggataatggtctttctctcagatgcttgtgacctcatgtacgtaagtgtggagtgcactgtttgaaagcgaagctgcatataaaagtgtcacgtgacttgtgtgtggtggtatggttagcacaatcgcagcctgggttgcacactcaaaagccacgggttcagttctactgggtttgtgtgacaactgtgcacacatgagtagcagaaaacattcatccagcctgggcaatatagtgagaccttgtctctacaaaaaataaaaacaattagccaagtctggtggtgcatgcctgtagtcccagctactggagaggatgaggtgggagaaacgcttgagcccgggaagaggaggctgcagtgagccaagattgcaccactgcactccagcctgggcgacagagaaagaccctgtctcaaaaaaagaaagaaagaaagaaataggggaaaacattcatccaaaacagacatagtgccatccttcatcagtcttactgtgactcaagtctgccagtacagaggaattgacttacagcaagacacttgattaacaattcaagaaggggccaatattagtgtcatgttagtgcaacggacgggctgctcagatgactggctgagtttttctttctgcaaggatgtgatttaatgaagctttccgggtagagcatgccgtgttgccatggagtaatttgtaggtggtatatgtggaattgtgtttcaaatgcaaccctactgtgtatgtatatatatatatttgaagaatggttcttttttgttagtttgttttgggacactttagtataattcaagggatctcagagaaaatgcccatgatcattttgctctttctaaaataaattattgggctctgatttcttcttttaaaattaagattaatttgttaaaacatttaagttgtgtaaatcattccccacccccacctcttttcttgaattgcgtttatagtgcttgtattgtagtaaataaaaattattcactgatttaattcatttttatttctcctgggtttttttttttgtgtgtgctccttgttttcctgttatagaattggttcagattatagttttttctgtctcttgttttttagttctgtcactaatgagtacatacaaatgccaggcatggtggttcatgcctgtaatcccagcactttgggaggccaaggcaataggattgcttgagcctaggagtttgagaccagccagggtaacatagggagaccccgtctctacaaaaaataagaaaattagctgggtagggtggtgcctgcctgtgggcccagctactctggaggctaaggtgggaggattgcttgggcctgggaggtttaggctgcagggagctgtcatcctgccactgcactccagcctgagcaagatagtgagaaattatctcaaaaaaaaaaaaaaagtatatacaagaacaagttagaaacacacatacacaaaacatttttcacaaagtgagttttcctacataaggagttatattttgttattgagcctgctatatggaaatatggttaacagataataagaatgagaaatgagagcttcccccgacttttctctgccatttgtattgaccaatttatctttgattagctgctctatgtaaaaagtaatgtcatggcagataaaacttgtttcagtctttgaaagtgatggcagcagcagctgtctggtgcggctgccatcacgccagccgctgcagggcatggggaggaggcagacagccccctcactttcccccacagcttgcagcggggagcagcacaacaggggagcagggagatcaggcagagagggatctcgatgtggagctggggggtcttagggacggaccaggcagaagccccgcccttgctcctacccacttcgcagctgcagccgcccaaaccagtggctgcagacttagatattcctgcactcttgggggcctgggaaggctcccctgcttttgcagtcttggaagtccctgctcctgctgcctgacttctccctactgttggcaccagctctgatcttggagcaaagtctggccaagcctgggtgccatgaatggcaggaggcagattcctgggtggaaggggccagggagggccggaaggctgcaggaggggctgccagatccacccactggagtgtggacttgtggtgccttttctgggcctccccatggaccaattggcacatacttcctaccctatgaggtccataaacgcaacccccaccccgctccccagctcagccagggcagatcagaggatggagagtcactagaggaccagctgcagagaagagctatcctatctgtggagagctgggaagatgatgggaccaccagctgcagagaggagctacagtatctgctgagaactgagcacacgttgggaggaggctcctctctgctgagagctgcagagttgatgggacaaccttcctgcagaaaggagccacccactgtggctctcctctgagctgttccagcactcaataaaactcctctttgtcctgttcacccttcatttgtctaaataccacattcttcctggattcttccaggaagaatccaggacgtaggacaagaactcaggcaaaggtgccactggacaccccaaagaaaaagcaacaccccaaagatcccaaaacataaggacatgttgttctaatagcacagaccaggcatgcatttccatttggtatctgagtggaacttaccattccatgaaagcagacttgatagaatgtgtaactaccctgtccgtttcaggccacgtggttgataatgtacatcttggccaggtgtttttattgtaagtcatttcaagccttttttggaaacagggatgccaatgaaataagtacagtaaataaacaaggatatatggacagttttttttctttttcttctcagcgtcagcacagtattcaccctgaagatggagagtcataggtttgaggatcagtatcaggggcattctggatcatctttcagagtggcagtccaagctaaaagcccagttccgccgcacagggtacatgagccagctgaggcaatgtttggctgagaacaagaaaaatgactcaaagaaagtcagtgtggacacctaaagccaggacgatgttccaacaagctgatgatttatagagcattggtgcaaccagccttctacctcatgcaaaacccagggagtagcctcatatggacccttttgctactttttaactggcctccaccaccggccacacttaagtttaaattggtgcagtggctcatgcccataatcccaggactttgggaggccgaggcaggtggatcacctgaggtcaggagttcgagaccagcttggccaacatggtgaaaccccatctctactaaaaagaagaaaaagaaaatgcacacctataatcccagctactcgggaggctgaggcaggagaatcccttgaacctgggaggcggaggttgcagtgagccaagatcaccccattacactctagcctgggcaacaagagcaagttagaaacacacatacacaaaacatttttcacaaactgtgttttcctacagaaggagttatattttgttattgagcctgctgtagggaaatatggttaacagataataagataatagtaaactccatctcaaaataaataaatataaataaattaattaattggtgaatgagaatttacttagagtcctctgcatgagtttctccccaatctgcaagtctaatggggtgactacctctgactacttatgttggatttcactgtatgtgtttatatatataaaatattgagataaacgcagtgtattttgattgataggtgttattagtctgctaggtttgctggaacaaagtaccataaagaggttgcacccaagaatcttccagaatcctactggtgctaactctccataggttggttattgtcattctgtccccccaaaattcatgttgatatcctaaccccaagaagcttagaatgtcagcttatttggatataaggttgttgcagatgtaattagttatgatgtggtcatgctggagtagggtgggcccttaaattcaatatgactggtgttctgataaaatgggaatatgtggacacagatgcggctcaaacaacagaaatgtctgacaggtctggaggctagaagtcaaagatgaaggtgtctgcagggccatgctcccgctgaaggcactaaggaatcatctgttccaggattctctcccagcttctggtagttccttgtcttgtggcagcaaactccagtcttcacacagcattctccctttgtgtgcatctgtggatgtcgacgtgaattttgaggggacataatgacaataaccagcctatggagggttagcaccagtaggattctggaagattcttggatgcaaccttattattattattattattttgagacagtctccctctgttgcccaggctggggtgcagtggtgccatctcagctcactacaatctctgcctcccgggttcaagcaatgttcctgcctcagccttccaagtagctgggattacagctgcacaccaccatgccaggctaatttttatatttttagtggagatggggtttcaccatgttggccaggctggtcttgaatttctgatctcaagtgatctgcccgccttggcctcccaaaatactgggattacaagcatgaggcactgcgtccaggctcctcatgcctttctcccaacccagtgacccctctcctcctctctgtctctctgaatctccccatcatcccagctccagctcaccttatcatcattaggaaatctttgttctcactggcagggaccttgcccaactctgcacttgcaatcttgaccaccaacctctagtaatttggttcattctgtctccttatttttttctagctgatatttaaagcatagccaccatatgttatctatcatgccatgcatttactaggttcctggcatttataaattgagcactttctggttttattaagaaaaggaactccgatacttaggcacatgaaacttttccaccttcagattaatcaccttaattaatcttaagagtggatatgtaggccaggcagggtggctcatgcctgtaatcccagcactttaggagggcgagacaggcggatcatgaggtcaggggttcgagactagcctggccaatatggtgacactccgtacaaaaattagccagacgtggtggcgcttggctgtagtcccagctactcaggagactgaggcagaagaatcagttgaacccaggaggcggaggttgaagtaagtcgagatcgcgccactgtactccagcctggtgacagagtgagactctgtctcaaaaaaaaaaaaaaaaaagtggatgtgtgaacgtgttggggtggagttgagcagtgaggtagcaatgagtctgttaattattgagtactcagctgactatacattgtccaaaaagcaaaccagccgccattttccactttgataacataagcaaattgctgggaatgtatattcaatcatgtatttgggaatttgagagtttccagggacatcagactctattgggcctgtctctgtgacaaggttatgtgtgaaggcaagaaccttttcttttacttcttaaagcccagcataattctggggacagaggcatgcttattaatgcattacattagcattagtgaagccagagatttccttaatgtaaataaagtaaataaagaaaaatgtggccaggcacagtggctcacacctgaaatcccagcactttgggagtctcaggcaggcggatcactggaggtcaggagttcgagttcagcctggccaacatggtgaaaccctgtctctactaaaaatacaaaaattagctgggcgtggtggtgggcgccagtaatcccagctactcaggaggctgaggcaggagaaggcttgaacccaggaggcagaggttgcagtgagccaagatcacgctactgcacgctagtctgggagacagagtgagactgtctcaaaacagaaaaaaagaaaaatgtgttcttactgtaatagactcagtaaatattttgcaactaaacataaatttactataattaccaagtggagtttgtcattttaattttgaatagtatgtactacggtttgagtatgccctccaaaactcatgttgaaatttaattgccattgtgacaggttttttgttttgttttgttttagcttttgtttttttgagatggagttttgctcttgtcacccaggctggagtgcaatggcctggtctcagctcactgcaacctctgcctcccaggtcaagcgattctcctgtctcagcctcccaagtagctgggcttacaggtgcctgccaccacgccctactagtttttgtatttgtagtagagacggggtttcaccatgttgctcatgctggtctcgaactcctgacctcaggcaatccacctgcttcggcctcctaaagtgctgggattacaggcatgagtcaccatgcccagcctatgacaggtttaataggtgggaccattaagaggtgtttaggccatgaaagctctgccctcatgaatagattaatgttgttattgtaggagtgggtttgttataaaagcaagtttggccctctcgtgctctcaccccctcttgcccttctgccttctgccatgggatcatgctgcactaaagtcttcaccacatgtcagcatcatgcacttggacttccaggactccagaaccatgagccaaataaacttcttttccttataaattacctagcttgtggcattctgttatagcaacacaaaatggactaagtatgtgacatatgcttttaaatgttataaaaattgcaaccatacattaaccgttctaaaacattgaaagtaatatttctttagagtgaatgaaaacttatacatttgaaaaaaatgaatgagacttctgaggtatgtaatataaaattatacaggcctgacataggaaggcaaaataaattaaatatcttaattggaaaattgatatttaactgtatttgcccccctatgacttaagagtagtctagacattatacttttctatctagtgtgctgaaatatgtcttgatggtaaattcaagtaatagctacacgtgtcttgtatttttgcagttagttgaatgaacaggtttagttatcattagtcatagaactccaggccacggtatgattaaataatattcaatttataattcattctaaatatgagttttatatttagattcctgttgagatatcacatagaataaaataatttagctctccctctccctctctccctctctccctctccccacagtctccctctccctctctttccacggtctccctctgatgccgagccgaagctggactgtactgctgccatcttggctcactgcaacctccctgcctgattctcctgcctcagcctgccgagtgcctgcgattgcaggcgcgcgccaccacgcctgactggttttcgtatttttttggtggagacggggtttcgctgtgttggccgggctggtctccagctcctaaccgcgagtgatccgccagcctcggcctcccgaggtgccgggattgcagacggagtctcgttcactcagtgctcaatggtgcccaggctggagtgcagtgtcgtgatctcggctcactacaacctccacctcccagccgcctgccttggtctcccaaagtgccgagattgcagcctctgcccggccgccacccagtctgggaagtgaggagcgtctctgcctggccgcccatcgactgggatgtgaggagcccctctgcctggctgcccagtctggaaagtgaggagcgtctctgcccagccgccatcccatctaggaagtgaggagtgtctctgcccggccgcccatcgtctgagatgtggggagcgcctctaccctgccgcccggtccgggatgtgaggagcatctctgcccggccgccctgtctgagaagtgaggagaccctctgcctggcaaccgccccatctgagaagtgaggagcccctccgcccggcagccgccctgtctgagaagtgaggagcccctccgcccagcagccaccccgtctgggaagtgaggagcgtctccgcccggcagccacctcgtccgggagggaggtgggggggtcagccccccgcccggccagccgccccgtccgggagggaggtggggggggtcagccccccgcccggccagccgcccagtccgggaggtgaggggcgcctctgcccggccgcccctactgggaagtgaggagccgctctgcctggctggccgccccgtccgggagggaggtgggggggtcagccccctgcccggccagccaccccgtccgggagggaggtgggggcgtcagccccccgcccgaccagccgcaccgtccgggaggtgaggggcgcctctgcccggccgcccctactgggaagtgaggagcccctctgcccggccagccaccccgtccgggagggaggtggggggggggggtcagccccgtgcccggccagccgccctgtccgggaggtgaggggcgcctctgcctggctgcccctactgggaagtgaggagcccctcttcccggccaccaccccgtctgggaggtgtacccaacagctcactgagaacgggccatgatgacaatggcggttttgtggaatagaaaggggggaaaggtggggaaatgattgagaaatcggatggttgccgtgtctgtgtagaaagaggtagacatgggagacttttcattttgttctgtactaagaaaaattcttctgccttgggatcctgttgatctgtgaccttacccccaaccctgtgctctctgaaacatgtgctgtatccactcagggttgaatggattaagggcggtgcaagatgtgctttgttaaacagatgcttgaaggtagcatgctcgttaagagtcatcaccactccctaatctcaagtccagggacacaaacactgcggaaggccgaagggtcctctgcctaggaaaaccagagacctttgttcacttgtttatctgctgaccttccctccactattgtcctgtgaccctgccaaatccccctctgcgagaaacacccaagaatgatcaataaaaaaataaaataaaataaaataaaataaaataaaaaaagagttcctcctgccttgtcctcctaaagtagttgggattacaggtgtgagccaccgcacctgccctaaattttttttaatttggtgtcctgagataagaaaatgtttcaccatttgttaaaattttcttttgtatcatttacaaaattgttcattaatttctaatagatacattcaatgttttttatactgagacaaaaaggaattttgaattttttgcaataaattgcattttagttgtgaatttggcatttaaaaaatccattctaataaattttcagtacaattaaaaaaaaataatttactgtaattctttctgcaagcttttaaagaaattatatgaggtaagactgccgcctgctggtcaagatgtgttgctcatttacatttcaaacttgtttttcacgatagcataggatgtgataaatccaattcaaagcaatccaacatacagacttttgagatgtcctaggttgtcacaaattattgatgcttggacattctaacaattatcattcccacaagcctttcgtgtttatccttccctcttgatgactgttgataacaaatctctggctgcatatttctgagtctttgaaatgtacaacttaggggctaagttgcatttatgctcctttctcttgagcaatgtgagctaagcatccatctgtaggtgagagatctctaagtgttgctgaacctgctgcataactgcactcctctaccttatctttttctgacgacatctcacaaacatattggcaatgctgctttgtcctcttctggaaccccagcataaagatgtcccccactcctctcactggctctgagcccagccccaaggtcacccatcactcaggtgatcctcagctcagccctaaggtgacacagtcttgtatcatgactccaggggagcagttcccaacctttttggcacgagggactggttttgtggaagacaatttttccatgaaccggggttggggggatggttttgggatgattcaagtgcattacatttgttgtgcactttatttctatttttattacgttgtaatatataacaaaaagttagacaagtcaccgtaatgtagaatctgggagccctgagcttgttttcctgaaactagatggttctacctgggcatgatgggagacagtgacagatcatctggcattagattctcataaggagtgtgcaacctacatccctcacatgtgcagttcacaatagggttcacgctcctgtgagaatctaatgcccctgctgatctgacaggaggcggagctcaggcagaaatgcaagtgatggggagcagctgtaaatacagatgaagctcgcctcctgctgtgcagcccagttcctactgggccatggactgggggttgggcaaccctgctctaggggacagataactgagtttgaaggcctgctctacccctgaccacctcaattactcattttggttgtgatgagcatgcactcctataataagtaaaaaataagttgttataaacatccttccctaaatgcttcaaccaccaacctgccctgacctgaggctgatgctgagttccaagggggctcaggtctaagaaacaaagttcagatgcaagttcttgggtgtcagtttcagttcccagacattgctccaccttctccttattcccaagaataccaaattatgcacatcctgtctgctctccccaaacttactgagcatgttgaaattaaattgtaccctgacaacttgaaaatccttttcatgattaaacaaatatttatggaacactttccaggtagcaagaacttgctaaatactgcatttaaaaagatgaatgtgctttccaaatgcttaatttgcaccatgaacactgcttattcaggactgccaagagagacccatccagcagaggtatctatcaactctattgaggaaaaaaaggcaaacacaagaaatttcaggcacgtgaagtttgtaagaccaagaaaggtaaaaaagaaatcttgagaaattcaaatgtgacattatgtaatagccaggaaagttactttgttgttgggattaaaatagttaagagatttttgtgaacttcttctggacatgggctcttttcctgatcttgtatttccagcacctctcacagtagctgcatatagttagcacttaattaacatttattgaactaattgcctcacttgctcttgcttactgaaacagtcataatcattatccccttcatctagcaaatacaaagttaggcggaatgcgcacagactaagtaagaaacagacaagtgaagctggagaagcttcaaatgtttggaggacgcctggggcatttctccccaggctccagatgaattctgtggtgctaactgtgatgcaggaaacttggagtccctgggattgcaaagtctgtctgccaaggaaggaggtcttcaaagtacatgagaaaggaaaacgagaatgaaaaatggatttggcaataaagatgagggagaaagtcatgcgtcacatctcggtgaaccttttaactgctgataatagacatgtatagcagagtcttctaaggctcacaaataacaacaatgacgctatgtgctttgcatgcattacctaagttaatgttcaaaacaactggaagcagatttgccccattttacaaatgaggaggaaaccgaggttccgggaggttgctagctgctcggtgcaagaggcctagatttctgcgtatctcagctttcaacatgcctttctcactaagcttaattatttctagcttttgatttaaagtgagagacttgagattcttcctttcacttcaacacttagaggttattgcaagattcttttttttttttttttgagacagggtcttgctctgtcgcccaggctagagtgtggtggcacaatcttggctcactgcagcctccacttcctgggctcaggtgattctttcatctcagcctcccaagtagctgggactacaggtgtgcaccagcatgctagttaatttttgtagtttttgtagagacagggtttctccatgttgcccaggctggtgttgaactcctggactcaagtgatctgcctgcctcagcatcttaaagtgctgggattacaggctattgtaggatttttgattgattgattgattgattgattgagatggagtctcactgtgttgctcaggctggagtgcagtggcgcaatctcagctcactgcaacctccacctcccaggttcaagcaattctcctgcctcagcctcccaagtagttggaattacaggcatgtgccacaatgcctggctaggtgtattgttttgtttttgttttgtatttttaggagcgatttgtatttttggtatttttaggagagatggggtttcacatgttggccaggctggtctcaaactcctggcctccagtgatccacccgccttagcctcccaaagtgttaggattacaggtgtgagccactctgctcggccggtattgtaggattcttaattggcctaatttcaatattgttgcgtctcagaaaatagggaggcctgaggagagagatggggaaatgtctggtgtgtgaaacagaacacacataacatttattgatgaagtttgctatcttacaggggcacagttcatggcaacccccaaaattataatagtaatgtcaaagacaattatcaagcagcataacatatataataataattaaaaagtgaaatattgtgagaattacccagatgagacacagagacgcaaagtgaaggcatgtggttggaaaaatggtgctaatgcagaaggttgccacgaaccttccatttgtaagaaatgcagtctctgaaaagtgttataaagtaaagctcaataaagtgaggcagccctgcacatgccttgttttctctgctgctgccatgctggtctcctgcctgttcctgggctgctgaattgaggaggctcaaacttgctttagggccttgctcttccctcagccaccacttgtctaacatgagtctttgctcaccttctcactttctcaatgaggactgagcaccaccccactgaacactgcgacatgctcttcccctgcactcccagaccctcttctttaccctctccaacccatcatggtccttttacacttctaacatcctatgcaatccacttatttattatgcttattcctttcttttttttttttgagacagagtcttgctctgttacccaggctgaagtgcagtggcgtgatcttggctcactgcaacctctgcctcctgggttcaggcaattatcctgcctcagcctcccaagtagctgggattacaggcatgcaccaccacgcccggctaattttttgtatttttagtagagacaagatttcaccatgttggtcaggctggtcttgaactcctgacctcaagtgatccacccaccttggcctcttaaagtgctaggattacaagcgtgagccactgcgcccggcctattatgcttattacttatgggctttccccatattcgaatgtaagctccacgataacaaggacctattcactgatagttcacaaacactcagaacgattcctggcaatgtgggcatccatacatacagtttgaataaacatatccttttgttcgcaaataaaaatgggattgtattgtagaaactgctttataaagactctttggcctcatattttttgaatgtgttctcatgtcaacagacatacgattcaaatatttttctatccgcatcatgggctactactgaataccagttttcgtcagttaatgtttaatcaatcaagcaattaatttgctttcatggtaaccttttttaaaaacagctttattgagatgtaattcacataccataaaatccacccatttaaaatgtacaattcacctgtaatcccagcactttgggaggccgaggctggtggataacctggggtgaggagttcaagaccagcctggccaacatggtgaaatcccttctctactaaaaatacaaaaaaaattatctgggtgtgctggcgagcgcctctaatcccagccattcgggagcctgaggcaggagaattgcttgaacctgggaggcggaggttgctgttagccgagatcgtgccactgcactccagcctgggcaacaagagcgaaactccatctcaaagaaattaaaaaaaaaaaccaacaaaaaacaaataataaagtgtacaattccatggcaacacatatctattgagagcaagacatctgcactgcaatcggttctgaggttacagctgtgaagatacagtgcttgccctcacagagattatggtctgtggggagaaggggacaggcagaaattaataaatacttgcacagataattacttcttagtgtggtaagtgctacacaggaaaagagacggcgtgtcctatgtgtaattaacagaagaccctaactagtcttagggcccagggcagggtcctgccaggaagtggaatttacgctgagccctgtaggatgagtaggagtcaggcaggcgaagggagaacggctggtggggggactggaatgttgttgtggatggatatgtaggttgtttaattatttcactaataaatgctgtaatgaagggccttaaattatttccttaaggcaaatccctagaactgatattgctaggtctagatgtatgcagatccatcctcccttcctctcttttttttttcttttttcttaaacctttcctatgtatcacattgctggaagggtggtggtttaggtgtctagggaattccaagtcccctactattttgctgcttccttctcaagatgattcagacaggattccaggagccttggaaaataagaccctatgggaaatctttgcaaactgaggctggcaggtagctgcaatgcctcaagtataaagagcatcgaaaatgctgaacattcaaatcaggttccagtagatctgaagtgtagtgagaaatcttctcattctccccctccccctcccccctccttcttcttccagtctccctttggagtgcagtgctgcgatcttggctcactgcaacctctgcttcctgggttcaagcaatcctcccacctcagcctcctgtgtgtgcaccgccacacccagctaattttttttgtttttgtttttgttttgtacaaaagagttttcccatgctggccagagagctcaagcgatcgcctgctttggcctcccaaagtgctgggattacagacatgagacaccacactttgcctattttctctttacttagtttctttcttaaatggaaagtcattgaagaactctataaggttctaattttgattgctttttcagtgactctgatgaacacattattgtagtatccgggcagtctagctatttaaatactaagtggtactgaaattatgaccattttgcaggttagtactgaaaatttcaatttcagttttaaattccaaataaaaaaaggcacgaagtcgtttacaagaagcacatgaaataaaatggaaattaaaaaatctgaaagcaggaataaggaaagaaaaagcaaattggccaaatcatactaaagagagaaataagatgagttataaattcaaattatatgagaggagaaggcatataatacttattttaccttaaattcattgagtggcctttttatattcagtttttcttgaaaaaatagttttgcttctctcctcagacatctttgtgaattgcccttcactttagttaggtcttgccttaaatgccaagacatcagagttctctcccatcacactaattaaaatagagcgtctgtctccagaatcctacatggtcttccagcttctacctttgttctttccgatccattctctatgctggagtcagagtgctcttttgaaacccaagtcagcccatgctgttctgtttgtttatttatttagagatgtcattcaggcagtggcttgatgtctgctcactgcaacctcagcctcctgggttcaagtgattctcctgcctcagcctcccaagtagctgggactacaggcgtgtaccaccatgcctggctaattttttttgtacttttagtagagatggcatttcactgtgttggccaggctggtcttgaactcctgaccttgtgatctgcccaccttggcctctcaaagtgctgggatcacaggtgtaaaccaccgtgacttacctgttctgctgtttaaaaccctccaatggcttccaatttccattagaacaatttggacactcacatggcctgtaaagcctttcctagtctggccaccatctcactcctatctctgacttttcttcttttaccactttcctgttgttgtgagctgaattgtgtctccctaccttccaaattcatgttttgaggtcctaacccccaatacctcagaatgtgaccttatttggaaataaggttgttgcagatgtagttagttaagatgaggtcatactggagtaggatgggtcccctaatccattatgattggtatgcttgtgaaaaggggacatttggacacagacacacactcagggagaatgcctcatgaagactggagtgatgctgccacaagccaaggaaataccaagcctaggagatggcctggaacggatccttccctacgccttcagagggagcatggccctgcaggcaccttgatcctagacttcaagattccagaacggtgagacaagaaatttctgtgaagccactcagtttgtggtactttgttacagcaaccctagtggactattacacctctgtttgctctttagcattctggactgttatggttcctcaaacaggccagatgtagttcctcctcagggcttctgcattgcaagttcaggctgcctggtatctttgcacaagtatttgcatggcccactcccttactcctctctgctcaaatgccgcttgttctaggggtcttctctgggccctctattaaaaacagcacccaggctgggcgtggtggctcacacctgtaatcccagtactttgggaggccgaggagggtggatcacgaagtcaagagatcgagaccatcctggccaacatggtgaaaccctgtctctactaaatataaaaattagctggacatggtggcgggcgcccgtaatccgagctactagggaggctgaggcacgaggatcacttgaacctgggaggtggagattgcagtgagccgagatcacaccactgcattccagcctggcgacagagcgagactccatctcaaaacaaacaaaaaacaaaaacagcacccccgccctttcatgctctatccctttaccttgtattatttttttctgtggcacttcacatatgatgtactttaatacgttttactgtcatccctcaccaatcccttaccccaaatataagctccatgaaggtaaagaatttctttaatttgttcactggtatatgctgagtctagagtaataggcacttaataaatatttgctgaatgaatgagtaaaatatgtaagtaaaggctaggcacggtggctcacgcctgtatcccagcactttgggaagcagaggcgggtggatcacttgaggtcaggagttcaagaccagcctgaccaacatggtgaaacccccatctctcctaaaaatacacaaattagctgggcatggtggtgggcacctgtaattccagctacttgggaggctgaggcaggagaatcacttcaacctgagaggtggaggttgcagtgagttgagatcatgccattgcactccagcctgggtaacagagtgagtctgtctcaaaaaaaaaaaaaaaaaaatatatatatatatatatatatacacacacacacacacacacacacgcacatatatgtgaaaatttaaatcctgaagcttggaactagggttaactgtaaaggcatgctaaccaatacattcctttttaaaatgagatattcctagttaccactgggtcctagagaaagagtatggttctggacttcagagaacttaaaatgttaataaacacacatcactagtgaaaattatatgaccggttgatatttcactttcattaagactttagattctctaaaataattaaacctacttttgataaagttaatatttcctacccactatttaattagttgtgttagaaaagaaatttgaagatatactgtgctctacacgaattacagggaaagcatcttatgtgcaggggaggaaattcctagagtggacaaatagtcaaatttaaattaaaagaaaactatgccaagtgacaactgctccattatcggccaccttgaaattgccatgttgaataccaccaggaccagctactccagctgcttgaagtcattgtagaccatgaccagggagaccatggcttccacacagaagctaagcagaccacggtaggaaacccatgtaatttttgttcaggcccacactgacggtgactgcacggatgtgactttcaatgtgattcctattgcttggtagtagcccctttgccaccgatatttatatatttttaccatcgcctttaggaatctctgtttgtccaactgaaaaagggatcatgtcaccagttaaggtgttaaatgtatttgtaaatgataaaagagccatgctatagaatattttgaaaataaggaaaaaaattacccaactgttaccattttggtaatgttttctgtgttcacatagttgtaattaaactatggctatgcttcttttttgtttctttttttttaggtgagacggagatttactcttgttgcccaggctggagtgcaatggcatgatctcggctcgctgcatcctctgcctcccaggttcaagcgattctcctgcctcagcctcccaagtagctgggattacaggcatgtgtcaccacgcccggctaattttgtatttagtagagacggggtttcaccatgttgctgaggctgatctcgaactcctgacctcaggtaatccgcccgcctcggcctcccaaagtgctgggattataggcgtgagccactgcgcctggccaactatggctatgcttcttataccctgggttttcattcctattatactcatttttaccttaccgcctcatcataaaatgagtaatactgcttcataatggtgttttagtggttgcctcaaattcagttaagtggatgaaccataattgacaacattttcctattgtgagacctttagtcacaacacctctgcccctgtccccagctttctgctattttaaactgcaattactatcttcacatttttaaagcatcttccatagtttgcataattctttactacaaatgtctaaaagtgggatccttggcagggaggaaagggttaactgagcggatctcggccacttaaaccacacacattaccaatgaatgggggttttcatgactggcccttggctggctccttggaactgagcccttgaaacattctgactgataagagcattttgcctgctgggaggtcttcagctatactgtacttcatttagtttttccatttagtttatcctaacaatgtgatttacagtgaagacctgcgttccctctctggctgcagcttcagtaactgaggtcagccatgcaggcactgtatgcgtatgtgatggccattaagaaaaactctgggccaccagtctcaggtgaggtgaggcgtggttgcatgtgttatcacacatccttgccggaggaattaagtacatcctttgggacctcacagagactctactgagacaggagacttggaaacttgtgcctggaagtttcctccagatttcgctccatgcacaatcacaggtgagtccatttagtaaatcgtcaagcttggagacccttgacacccctggctatactgattggcatcagttgcagataatgaaaactactctagctgattaaagcaataagtgtttattgtcatgtattctatgatttccaaaattgttgaaaattatttactagcacgtattctgtggtttccaaagatgttggaattgctaaaaaagtaaatggagcttccaggaaccatttctagcaccagcatttcaccgcttctgccagaattagaaagccaccaaactaataagctatttgctataaaaatcatactgccttagctaggatccatgtcagcaaaacgcgtgccttacatcttaccttgctgccctcttaactcacccctgaatccaggcatctgaatgacagccatatctgacactgtaactgcaggggcatctgcaaatggagcattttgcatttacagtgctcaaagatacaagcaggaaattagaatttatgctgagtgagctaatccacagtatctaacacattgcattcaagggtatgaatattttaacgtttcttggtagacactgccaaactgcttttccagaaggctggagaaattcacaatggcaatagcaatgaataacgctccatttttccaacactttatagtttcctaatgagggaaagataatctcagcagacaaaaacaaacactaagtcataaggcactgtgtgtgctcactctttttcttgctgttttctttgaagaaaacagatttgttaagattgtggtgaggaataatcccttgcttgaaagctgcaactctaagtcgatttacaaatcaactattctatgatggtgacttaaaaacaaacaaacaaaaccaaagcaaggcactcatccgtgcaatgctggactaagcaattttggttattgttgaaaagtactgaataaagtatggggaaggcttattttacttttataagtctctctaatttataattttctgttcccacagtgaagagaattgtcaggttcctcatcttggtcctcctccaggccctgcgtctcttcaatcagtcctacataattaccactggttgccttagaaatagggatttgggcttggggtcagctgctttgatctttgaggttgagatttctgcttgagaattttagctgttgaaagatgtaacatctcatccagacgtgcaggaaaataataactgtgatggagatgtttatatacacaagggatggcataaatgataatgacataaacttcctaattccgcaaagatacttacaactttacaattattgggtcataggacacttcgtcaatttgttaaacagaaaatgaatagaaaatgaatacagggtatttatgatacactgtcacaatgagatcctattctagatattacatgtgtatgcagagaacattgcaaaggaagcatgctaaatgcttatagcagttatcaccaggggtgagacagtgagtggcttttactttattccttatacattctggattgtttgaaaattctaaaatgagcatatcttactttaataaagattttaaaaggtgagaaaaaaatagttaaaaaatatttcctaataccttaaagggttgtagtagatttaaattacataattgataagaatgtatttttgtaaattatgtagtattatgaaaatacaatgtagtaaattttcctaagtccatgatctcccctccttacttagaattaatgggtctgatgcctttaggtatgtttagtttaagaattttattttaaaggaatttctgtggcataacataaggtttatggtacttttactaaaagtcacttataatgaccaaattataacaatttttgcaataagctctcattaaattttcctaaaagtagaaaaagtacacattatataccattttgcacttaattacttctttaaaatctcaaaataattcagtgtaaaatgttagtttcaaagacaatttatgggaaattacaaagcaactacaaagttcttcataataaatccaagataaaagtaactttttacaggttgaaagtttttcaaaatgcctaagtggattataaatacagtttggccatctgatgaatttagaggcactttaaaaggtgtctagttgaactactacagataggacatgtttgaggaaatttaatctttaagtctaataccagtgttcatttcttcctgccaaaacaagaaatttattggaaaaatccatgagcagcatgattagtttgatttctttctctttttttagagacagggtcttgttctgccatgcaggccagagtgcatgcaggccagagtgcagtggtgtgatcgtagcttactgcagccttgaattcctgggttcaagtgatcctccctcctctgcctcccaaagtgctgggattataggtgtgagccaccatgcccaacctagtttaatttcttcataaagattcttttataagttgtgctaatacctggaaggcctaaaacagaaaaaaaaaattagaattaattaaattaggatactatattggaaaactctgtaataactttaaaaatccaaacaaagagtatctgtctaaggttgagagaaggcattgaaaagtcaagtttaacatcaactttatctgtgcaggatgccatcaatttctattaaaatatgaagactgaagtacatcagattttcaggattttgttgttgttgttgttctcgtggccttcaagatcattttccattttatccataacatggattattttagattttacataatctctcacctgcattttatatagattcaattgcccaactccactaatacattaaaacagagagaccttatgaaaaacacatttaatgacatgagaaagcaagtaaataaagaacatgccaaaaatgtccctttccaaggataaatataaactcttctcaaggttaatggcactgttcaatttatagctcttctgtttgatttccacatacacagcttattttggttaaagctagattgtgattcagaatattattctatttgacccttgctgatacttttttcttcagagaaagtgacagccatcatgaatttgtacttctggctcatgttaattcaataaaggaaggaaagaagttttcctcataacatgacaatttacgcagctcagtaggttgtgatacattattcatgcagacaataaattttaactccaatttagtctcatttctatagaagtctagcaacaaagtaaaatgggtcttttaatgatagttcatgactggtcaacaaatatctgaattttagaaacccaaacagatattaagtaatattctaattcacaaagtatacacgtgcattaaaaaaacagaactgctagctagtgttactctgaggagaatactacactcaccacatccatctgttctggagaagctgaagagaaggatgctctcaagtaagggctaggagctgagctatcgacgtagaaagcatttccagggagcattaatacctaagagagtttgtggaagataagtaatgtaccactaaagaaaaactcaaagataatatagttaagcctaatctcagagtagggaaggatgttttaagtttaaaagcagttaaagaaatcacaagaaaaaatactaatttatataaaaattgcgtatgtcatacaatgaacaaaactaaacacatagaaactgaaaaaatgttcagaatcaatatggcaaatgctatctcttctcaaaacatcaggaatacacgaaaactgagaacactcaaatttcagctttaatgtagaaaggacagcttcctaaagaaagataaatggtaataaatacaaacaaatgtttaatctaactagaaaagtaatttttaagttaataagtctgaaagttacttttaagctggggcctgaaagataaattacatcaggcaaaaagcagggagcagtatttgagggcaaagatacacagagtaaaggccctgagatgggaagaaaattgctgcattcaaagaactgaaaggaggtaaaaaatgtaatgtataaaatgaagaaataaaagtattaaataagcgtgtcaagatggggtggtcggaacagctgctgttcttgatggccacacaggcagacagctcactgactgtaagctccatttcctcttcttcctgggcatcacatgtaccctattccccggcctctttctagctgtgtgtgaccatgagagcgaatcctaatcaatggatgtgagtagaagccaggtaagagatgtctaaggttggcccatacaaatcatcccatgtgtgatctgccatgctctttccattttgtagccatcttggaatctgtgtgttgaagaatgaaaagcaatgagatgtaagaaacccgggtctctgaatcactgttggaacacagagggttgcaggtcacatcttagaattatatgtgagtcagagataaatttctattgcttattaagtctttgagattttcaagtttatcttctgtggtggttagggttgactagtataatcatgatcttcaacagcattgagtaactgcttgttacactgtctgctaagacaagaggagttgggagtgatatgatttggagtactctgggcaaaagatttcaaggcagaagatgggtttctctgtcctggttgaaaataaaatgaaaaccatcatttctctcagtagcatggaaaagttctgggatgtactagaagcaaggagctgaaagagaagggagtggtggtaatctcttcacaagataaccaacatctgggctgacaaagtggggataaagctggagattatttagaaaaggtaaaaaaagaacatgtagcaggatatatgggataaatgaagaggactgaagaagagtagagtaaaaacaaagtctatatccttagcgcctcgcttagacatacctacagataaccacttaccacatattttgaggataatggcattgacagaaaagaatgtatcaaattgatttattatactacaatgcatttatttgaagtaagtcaattgtttatcaagtacctactatgtgctgtgattagggttagaacaattaatgaagtctgagtcctgccctcaagtaagatggctaagagaggataatagctttcccaaggtggtggaggtaggactgaagtccaggcagtctgtctctagctctaacttctagagcaccttgtctcttatgcaccagcatggcactttgccatcatcaatccaatctgtcctttagttcttatgattcaagacaaaagtgaatctagcagtagggtttcagtgtgtataaaagactgacaaacatgcaaatggctttaattaatggagaaggaataatttatctggtaaactggaaagctacacagaaaaatatttagaattttcagcttacttgatgcctccaatgaaacctaagtagatttataatttaaatataaaaagaggaaaaaaaaaagaaacctagaatacattctatgagctaattttaagtgaaaaaaaaatcaggatacaaacttttctgtataattttaactatgtaacataagtgcacagccaaaatactgtaagaacaagcttttcaaggaactatactataaatggtcacaaaatctgggtagtaaaatcatgggctatttaaaaaattttcattatgcttttatacattttccaaatatcctaccacgagtatactttatctccatcatcagaaaacaaacccttcattttaaatactagtggctaatacttactgagcactgagtatgtgccacatactagtctaagggctttacatatattaactcacttaatcatcagagcaaccctatgagagagggattcttattacctctgttttacagacaaagcacagaaagggtaacctattcaaggccacacatcccctaaggggtggtgctgggattcaaacccaacaggtgtggctccggagactaccctcagccactacgctaatcagtagctgagatgaacaactatatttccactaatttagaccagctggataattacgtaacccaaaaacctcttacgattttgataatgcaataaaatatctaatattagaacattatgagttggctggtgggcaacaagaaacatttctttccattctattcaagcaaaatattaaagaaaaagtataacttttccttaggtttcccagcccttcacctcccagttttacccccatcttaacggccttttcttcaatcagttcttttacatcattaatgcctttaactttaatccataaaaacattccagcagcaggaacatgccattctgccaaacctacaaacaaaagaagagaataaatgtcttccaaaggaaggcatttttgatgatatcaaagtgtgttgttaaatggcataagtatagtaagtagaaactagtattcctaaaaaagttccttcaattatagcatttttaaaaatatcattttgtgagccttcaaaattgatgttctgggttttatttcaaagagttactgtgggtgagggaagaagggaggggtagggtgggcaagtgaatagctcgcgtgtgcgtatttacaatgtagtcagtcttagggtagtgcaagaaatcccactcctctctccttcacttagaaccatacctagacaaacatggctatttcaatttagaagaggattcttccattatttgtggattcttccagcattacaacaaatcctagtattcttgtaatagtttagatgtccagtggattagcgtttttatcagaatgtaattaattatgaaaagaaatacttaaaattcaagaattccagaagcagttgtgggctttacgtttcattgagtattaggatagagaaatcaaaaacaagcataatgatctttgatttaaattactatctttttaaaaaaagaacttgctgttgattcaaagtttttcttcagtactattatgcaaagtggtaaaataatgctattgtcagaaagatactaattctgtttttttttttttggatggagttttgcctcacccaggctggagtgcaatggcatgatcttggctcactgccacctctgccttccaggttcaagtgattctcctgccttagcctccgaagtagctgagattacaggtgcccgccatcacgcccagctaatttttatatttttagtagagatggggtttcaccatgttggccaggctggtctggaactcctgacctcaggtgatccacccaccttggcctcccaaagtgctgggattacaggcatgagccactgcactcagccactaattctgtttttaccaagactttatagaaaataagataggacagaaataaggaattgctatttttggtttactattatttatatcaaaggcattttaataatataattaaagccatatgattaatttgaccttcataataaaaaaagaatctaaaacattttgcaatcaagttagcaatagataatactacagagataaatgaggttaatgattagaaggcaaataatttgtcagtaagacatctgcctttgtacagcttagttagagaagcatggtttgacaattttaccctttggggtaaaattctgaaataactaaaatttttgaaaatagatattattaagctttaagtaagttagtgattgatttttagatctttttttttttaatcacaaattctttgcagcagacaggtaaagtggataggaaggtctgtgcccaggtttatcaaatgttgcttctgagatgatttatggtgtaatgtttccttggcaagaatactcctggactgtttcttttccaccaggattgttagtaatattcagtgtttatcccctacttttacagatgctactgtttatcatgaggacgaatatacgttccactcaccagttaaccacttgtctgcagctgccagtattgcatccttctggttactatagaaatcaataaccctagaaaaagaaaacaatgaaatggatgtgctcagtacattgattgcagaagcaaaacagtctccagagtccaggctataagaatttgttttctatcttgattaaaatgttgaatgcttgatagaagaatggagcatatttgtttcacttgtctggtgaaaaacttttaactgctgtgttttttccttcattgtagaataattacaaaataaaaattcataaagagaagtccatttctatgtaaaatatggaacctagaagtagcaggatcaatctttgtgtttagttgtctaaatactggttctcatcactcaggataaaagacaatactattgaaataatgaatcaccggtctgggaatgcgaataccccattcctccttatttctaaatgtcctaggaggtaccatatttacacagctaaagtaatccataacttgtaccaatatacagactatttagggaaattatgttcaccttcatctttacttgagccaaatcccgtgtcatgtatccttcacaattaatcattattaaataaaatatttatatgtatgaagtttacccattacatcatttaagtaagtaaatcttaacctggtgggaattttggactaccttaggagtgggtggacactgctttcaaaccacaccttggatgctgagaagacttgctaggtgaagaactaacaaaatgaatagacttttgacttataatagaccgttcctattgtctctcctttccgaggatacttaggaaggaagaataaatcaatactgtaggtgatctgtactatgttcactgggctcctgttttgttcataaatatttaaagaaatgatacaatacctgtctacatgagccatgaaaccttcttctccccattcgtgtagaagctgtgatatcatgagctaaaagagataaaatcataaataccatgtttcatcccctgaaaatgtactttttgccatatataaaagcaactcacttttgattacatgtaaaccacaataagatataacaagctgagcctagcttatatagtcagtgatttaaaacaaatgtcaattaataacaatgataatactagtaaaaataacaaatattgatatactatttgttatgtagcaggcactgttgtaagatactaatatattttaccaaatgtaatctctataaatttctattttactaatgaggcacaagggttaagttaacttttctgagtcccacagcctgaaatcagtcaggctatccagctcctgacccgcgctgttaattgccatactgtactgcttctctaaatataaaaatgtacagtagatgtgtaaagttacatgacatatttggagattttctatttaaaatagaagttctaggctgggtgcgatggctcatgcctgtaatcccagcactttgggaggcccaacaggggtggatcaccagaggccaggagttagagaccagcctggctaacatggtgaaactctgtctctactaaaaatacaaaaattagccgggcatagtgacgtgtgcctgtaatcccagctactcgagaggctaaggcaggagaatcgcttgaacccgggatgcagaggttgcagtgagccaaggtcatgccactgcactccagcctgggtgacagggcaagactctgtctcaaaaaaaaaaaaaaaaaaaaattaaaatgttataaattgatagtgaacgtctgttgataacagatacaaaaaatatgaaaaaaagtctccaacttggtaaaacatggggccatctgcactttatggaacatacaatatcaaacaagtgtcctattctacacaaacttttctattctattcatattcttgcaacctgagaggttgtgttacagacggatccaataatttctcaaagtttgtaaggaaatttacacattctcttaaattaagtttactttattttaattaaaatgcattccaacccatttctttagaaagattagcatgtctgcaaagaaggcaaactatgagtcactaaacaggtttggagttcctgtgctctaccatctattatttttttaaaattctaatctgattacaaaaaaaaaatcgatttcctaaattgtccttacctggttaaaagtgctggggtgcaatgttgaaacttgtatgtgtaaaataactctctctattaagggttttggaccagttaaaaatcctattctcaacctacgtggaaagagaaaaggcacgataccaattccatattaacaattaatacatatcactttcctgatttcattagacagacaattgtgacctggggacaaaaggatctagataattaaaacattctaataaaactaactacttcttatttcaaaaacaaatttaagtgtacatttaaaacaagatcgactacgtatttcgaaatgtgccctttcatacctgatatcaaaaacctgactggtccgactacaactttagataaacagccaagaatctttgactattgcaggtgaataaagggaaaaaaaggcctgtgttaatattaatcatgaaactggtattttaagacaagtagactacaagcattttaagtgaaaaaaattgtctagactaaaagatactgaggtactatctctggctctattagatctagcgtcaagttagagacacagggccttacccagaggaaatgatttttgaaaaagagtcagctctgatgacacgtccatcaacatccatggaaagaaatgttggtaccctgaacttaaaatgaaaaataaaaaatactgttggtctgaaagctctgttagtcactgtacgattattttgaatagagagtagaacaggagatggatttggataacaacagtacaaatattctcttacctttatttcaaccctttaacatggaataacaaacaaagatgcagattcttttattagcatctgcttgtcttcatggcttttctgccaaaaacacacacaagggcttattatttgctccagatgccattattatgaacttaaggaaacttcaaacaggccctctttgccccagaggttgaaatccaggattaacagacttacaggagggactcaagaaacactagtttgaacaagaccataatgaggatggccagcagcactgaagggtgttcagagagagaacgctgatccttaggaccgacagaaagaaaaatgatgagaatgaagatgagaaattagtcaacatgaaagactgacttcaacatttactttaaaagtagctacaaatgagaaaggaaatttgctggcatgctgatggtgggaggcaggaggcaaaagtgatgttttaggaaaccctgtagagaaatcaagagttcttatctcttcccagtatatttaagggcaagctgaatccaagtatatgttctttgcagccctaagagcaaagaaagtgttggcttttgaagaatcaggcgttggtcttaacattatcatcatctatcagaaaaaagtcatcatgaaaggtagctcacatacatgatagtgtgagaatcaatctaaatgcccattactctgcagtaagatccaggacataaatgacagggtggcaaatgtgggatgcgctgcctgtgatgcctcctcttgtgtccatcggggatgctgctaacagagcacagcctctttctccttcagcttgagcacggcttcctaatccttctcatacatcattctaatcggccaccaccaagacacagaagtcaacggccaaagatgaaactcagttcacatccctgggtgatgtttgaggagctgttaacttggatgtggagtttaagacgtccatcagccctgatttactctgtttgtcccagtgcctggtatagaaagccagctactattttgaaggtaagtaatttctggaaagagcagtaataccaaaaaagaaaggtactaattccataataaaactggaagactgaaaagtaaagtagtagcaaattaatcataattgatttattttccatgtaaaagtggattagttctgactcagcagtcagcctaatacccaacacagtgcagtaacttaaaacaacttatcttctaatagtgaagtaagttcacataatcacttaccttgttaaactggagaaaatagtaaggatcatcttctattatgaggaaatcatattttcttgcaagctaaaaaaggttgaagtaattgtttatttcttaatctatttatttcttaaaagttatctaaaattaaattcatttggaattataattctttgtactcattcaaggaactactgtgtgtctattgtcttagacaacgaggataaaaagaggaacaaggcattaaaggctcttattctcacagaagttagattccagggggaaagacagaatatacataagcctgtggatcatgagcagaataaacattagatgagtggttttatttattttgtttttttgagacagagtctcgctctgtcgcccaggctggagtgcagtggcgcgatcttggctcactgcaacctctgcctcctgggctcaagtgattctcctgcctcagcctcctgagtagctgggattacaggcatgcaccaccacacctagctaatttttgtatttttggtagagatggggtttcaccacgttggccaggctggtctcaaactcctgacctcaagtgatccacctgcctcagcctcccaaagtgctgggattacaggcgtgagccactgcgcccagctagatgggtggcttttaagtgctgggcagagcattacaacaggtgagggagagagtgacagggtagctatttcaggttcaatcactgagaaggccttccagaccaggtaatatcagagcttaaaatgacaggaaggagtcagttgtgcaaatatcagagaagaatctagactgagggatgaatgtgggcaaaggccccaggataagcaaaacgcttgacatgtttaagggctaaaaaggacagtgcggctgccccaagtgcagcaagaagaatgataagagagaaggcttgagaacagaccgaccgtgttacctagctctgcaaggcagataaaagaatttgggctttattttaactgcaaggagaaaccaccggagggctgtaaacaggagaacccggagccgggctttatactgacatttctgcagggacagatgtggctggctgctgtgtgaagagtgtgactggttagagggcagggcgaaatgcagctggtgtagtgaagaaggcattggaggagtccagtgagggcaggcaggggctcagaagatggggacagtgatgacaacagagaaaaatggatggacttggataagctcagtggtagagtccacaggagaagcaagatgtgggggatggggggcaaaggagggaacgacaggaataaagggtaaccattcatagttgcactctttatggagatggagaatgtgagaggctgtagatcagaggtttggggtggggctgtggaaaaccaggagttctattttgggcatgttaagtgtgaaatgatttttagacatctctgtggaggtatcagcagaaaggtggatacagaagcataggcctcagggaagaggtaggggccaggcaatgtgccggtcatcgtgtacgtaatggaatagacagctacgaaactggacaaggctgtctggtgagtatgtaaacagagaagagaacttaggacagagcctggaaagtacaaacataagaacatgactgtgtgtgtgtatgtgtgtgtgtgtatacgtgtgtttatatagatacatgtatatatatgtgtgtgtgtgtatatatatgtgtgtgtgtatatatatatatatatttagagttggggtcttgctatgttgcacaggctggtcttgaactcctgggctcaagcatcctcccacctcagccttccaaagtgctgggattacaggcgtgagccactgcacccaacctgaggcaatattttgaacctaaaaattttctaagtaaaacgaactggctgaaatctttcctatgattccactggatgtgactaaattctatagagtttaacatgggtttggtatttattttaaaaagctatttgtagtgaaaggttggggacacagtcaggtacataaaaagagactttccaaaaagcacatttctcttatttttcaaagatttctggggagcttaatatatgtttgatacttaaaaaaatgtttatagtgaaaagctaggcatcatcggtatctcaaatagattttatgaaaggggagcatgcctctcatttttaaagaattcttggtaacctaagatgacaaggagtaggaagcagaacagacaagttaacaacacagaaaataatggaaatcaaacttgggataaaatattaaataatctcaaaaaatttaacatcaggccaagaatgctgtttcttttatattaaaacatcaattatggggaaagaaaaatctcataactaatgaaagatgcagaaatttattgtgtctaaatttattaggaccctgagcatatatgatttccttttattaaaaattatattccttgaaagcaaaaggctaagaagaaagggagcttgcatagtgctcttctaaaaagtcacagagaaacaggaacacaactactttaacccattcttctacaatacctcatagatttcctttttgcgttcactggttaatgagtttccagtagggttgttgccatttggaacagtataaagaaatttgggggtgtttttctggggattctttgcatcttctggtttccatctggaaagtatgtctcttagggaatctggaacaatcccactttcatcactggcaacattaataatgttgcagcccagtgggtgcagctgttgagcacaaaagaaagcctgagtcagtcatgattacaaatgtaagtgctattggttttttttttttctttctaactaagaacttgctcattcatacccttaaaaatatataaacccgcaaccagctctgagctcctgagggttgaggttacacatttatttatttttttttttgagatggagtctcgctctgtcacccaggctggagtgcaatggcgtgatcttggctcactgcaacctccctggttcaagtgattctcctgctttagcctcccgagtagctggggactacaggtgcacgccaccacgcccaggtaattttttgtatttttagtagcgatggggtttcaccatgttagccaggatggtctggatctcctgacctcgtgatccgcccgccttggcctcccaaagtgctaggattacagccgtgagctgccacgcccctggggcagataccattattgttcaaaaatacctcctgtcccttcccagagaattatataattctttcttgccccgtttacgtcaggtatggccatgtgtcttgcagtgggcaacaaattcggggcagaagtgatgcatgttccttccagtaagaagctttaaaatccagcttgtggttgtctatgtctcttttccctctgctctaagattgaccatgtttcagatagagattgcttctgtcaatctggggcttagaagaaagatggcatggaactgagctccagcagtcttgtagtggatatggaacgtaagggaaataaaactgtactggggtcattggttacagcataacctagcttcttctgacggaattatctttttttctgatttttcctttattattattactttttcaactttcattttagattcaaggggtacgtgtgcaggtttgttacatgggtatactgcatgatgctgaggtttggggtacaattgctcctgtcacccaggtactgagcatagtacccaataggtagtttttcaagcccttgcccccttcctgactccccccagcagtcagcctcagtatcttttgttgacatctttatgtccctgatgagtacccatgaattatcttcataattataattattactggtttatgaagtaggcgttttacaaatgaatgttttttgatagagtaaatcatatgtttcatttactgttgtgttcatatataaaacagtcacaagcagaggtgatattaaaaatatttaacaagtggtatagcatgggtatatcagatacagcgcagcctggaatggggacctgtaggccccctgttatgccgacattaactctggaacatgggaggttcagggtggtcctaggagaggggtcagggaagccagggtagtggcgggacactgaatgggatgagcagatcaccaggcagtacagtagaatttccatattttaccaattgctaaggctgaactggcttgtactggcattgcttatagacttagctttatacaaatttgtggaatctcattcatggttgagcattaaaaagaaaaaaaaaggaacttaagaaataataattgaatgaggttctaaaaaaattgcaaatgaaaagcaaacactcttttagcagtcaaatgtagaattacgcataaaaaaagaacaattcagatcctccttatgacaaatttaaaaggccttaaccttatgaagcacatctaccatgaataaagcaaatcaatactgggccataaactaaacacatactgcttattagcatatttcctcaaagcttggcatacagtttctgtttttctgtttgggtatgtgaaaacatttgtgcgtgtgtatatgcacgctttatatgtagacaccggttttacattcatagacattatgtaatcttaaatcttaggagtttaggaaaacaaattatgagtatccaatcattgagaaaaagtaattattttattttagttttattgtggtaaaattgttgccattttaagccttttttgtttgtttttttaagtgacaaggtctcactttgctgcctgggctgaagtgcagtggtgcaattatggctccctgtaacaccatgctcctgggctcaagcaatccttacacctcagtcttctgcctggttaattaaacaaacaaaaaaaagttgtagacatgtgctttgctatgttgcccagtatgggctcgaactcctgacctcaagtaatccttcagcctcagctgcccaaagtgctgggattacaggcgtgagccacctcgtctagtccattttaactacttttaggagtacaattcagtggcattaattacattcacaatgtgtgcatccatcacctctgtctatttccaaaactttttcctcaccccaaatagagactctgtacctattaatcaataactctccattctctactctccccagcccctggtaaccactcatctactttctatctccactaatttgtctattctagatgtttcatataattggaataatacaatatttgtccttttgtgtctggcttcttaaagttaaaatgctttcaaggttcatccatactgtaatatgtatcagatctgtgttccttcttatggctgaataatattccattgtatgtatataccacattttatttatccattcatccactgatggacacttgagttgcttctaccttttggctactgtaaataatattgcaatgaacatttgtatacaagtatctgtttgagtcccagttttcaatcctttctgggtatatagccatgagtggaattgtgggtcacatggtaattatattttaattttctgaggaactgacaaactttcccacagtggccataccattttacatttccttccaccagcagtgaatgaacccagtttcttcacatattcactatttttttttaaataatagccatcgtggtatgtgtgaggtagtatctcacagtagttttgatttgcttttctctatttaaaaaaattttttccccaagcctgagtcttgccaaataatcagactgcaggtacagcagtcacacattgtagagtactaaccactacacgatcatggaacttgcggctttcatacgttgatttatgttgctttgcatttctctactaatgatgttgagcatcttttatgtgcttattggccttctgcacatgttcttcagactaatgtctatttaagtcctttgtccatttttaaattgggttgtttatctttctgttgttgagttgtaggagttctttatatgttctggttattaaaggtttatcagatatattatgataaatattttctcccactgtatagactcttttttcactgttttcataatgtcctttgatacacaaccacttttaaatcttcaagttcaatttatctatttttgtggttgtcgttgctcatatttttggtcatatctaaaaaatccaccaaatctaaggtcataaaaatttgcccttatgtcctaagtgtttgtagttttagcccttatatttaggtctttgatccattttgagttaaattttcatatggtgtgaagtaagggtccaagttcttttatatgcatgtggaaatccagttgtcccagcaccacagttgaagagactatcctttcccccactgaatgatcttggcacccttactgaaatcaactggatttgtgggtttatttctggatgctcagttctattctattggtctatatgattgtctttatgccagtaccacattgtttgattactgcagctttgcagttttgaaattgggaagtgggggtcttccaaatttgttctttttcaagattattttggctatttaggtcctttaaactcacatcaatttgaggactggcttttccatttctacaaaaaaggctgttggcatatcgatagggattgtattgaatctgtaaattgcttagggtagtattaatatcttaacaatattaagtcttccaatctatgaactgtggaagtctttccatttatttgagttttgcttaatttctttcagcaaaatttttcagtttttaatgtacaagtcttccacctcctttgttagatttattcctacgtattttattcttttggatgctattacaaatggaattgttttatatattgctttatatgttgattttcataaaaataaaataaaatttgaaaaaaataaaaggatccatgaagttggaatcaatagagcataaaagtcatcgcattgaattcccctactctaagctagaattactttagccatatttgtgttaggtggcagtcaagagtgactgagcacctacagtgatgggcaatgttgtaacccattatgaagtccggtaaggccaatggttagcaagttcttatacagagctgaaattgtttccctgtggttccagttctattaacctaaggtcatgtacaaataaatctaattcttttgtcacatggctaacttctatgtatttgaggacagttttcatgcctctgttgagtcttttctttctggggaaaatagctccagttcctacaaccattcatcatatgatatggcttccaattccctatttactctgactatctttctctgagtatgctccagttgtggacatttctgtcttaaagtagactgccccaaacaaacctaatgctcagcaatgtgctctgaccagtgcagagcagagtcagatcatcagcttcctcattctgtaaatcacagttccacggatctaaccttggaatggaaagtcgtcattataccatataagtatactaaactgacatataacatagttgtacttatgcatatggtaataagatagtaataaaaaataaatttttgtaatttaagttacatttcaagtaaaatattaagagaattggacatgattttgcataatctaattttaatgcctatacacttggatttcaaaaaagaaatgtataaagaagagaatacatttcacatactttgtatatatcctttaagattatcctgcttatggataaaatatgctatttcatttttctgtggacagattattttaaagttaataagatattaactttattataataaagttattataaaacctttattataagttttcttcttatttactacaagagagttgcctttagtaaaaatgtatactcacactttgaagagttcctgaataagcaggttcatctaggaggacattatctccaggattaatgatcatttcaaacacctaacaaaagaagcataggttagcttgttagtcagcataggttagtactgtttccatgctcagaagcccattttttagtttgagctcacatggttctagagtaagaattagcaaattgtttataaggggccaaacagtaaacactttgcgggtcatagtatctctgttgcaactaccctgcaactactctgcctctatagtgaaaaagtagccatagacaatatataaatgaatgggtgtgactgagttccaataaaactttatttacaaaatttgatgaagggctggatttggctctcaaaccatagtttgccaactcctgttccagagaaaggtgaacagaggtttggctgctaacattcatttattccttttattgcttctttgaaaatctattaaatgtttactatacgccaggcctgtgtaaagtgtcagagataaaatagcaaaatgacatggttcttactctcatggagctactggtccactgggaaagctagacaccaattaaataactacccaataaatgtgcaaattaaaaacggtggtgagtgatattaagtacagatgcacaatgacataagagctcattgtaggaagacctaggcattcagggaattcagggaaggcatcctggaggaagcgatgagttggtgtacggggtaacaacagttagatttgaaaaaccaaaataattatgtgtcttgaggcagaatgtagagaaaagagtggtgtgacatcagacagaagtgggcagagaccaaccatgtaggcatttgagccaagggaggcaagtaaggattttaggaagagagtggggaggaggagtcacatgattagatactcgtcttgaaaagatcaatctggctgcagtatgaaagaatgaaagaagggtgagaatacatgtggaaagtttagaaagtttttaggattgtttgggaagttactgccacaggcctggaacaggtaagggtcatcttaaagtagagtggtgacagaggaattgtagagaagaactgagaggtattaggaaatgaaaagtaatggaacatgattatggacaatagggaaatgaggaagaggaggtgtcaagaatgatgcctagatacttggttatggaactagatagatggtgggggtggtgccattcactgaaacacataaccaaaaagccatccatatctgagtgacaggatgatttgttttagtgtgaggtgcctttgaaacaccctgtgatgatgtcagatggatagatggacaaatggatttggaaggagcctggaagttactggcatatggttgatcatgtgaatgtaaatgaagatacccaggaaaagtacatagactaaggagagatgtttaaggactgagctacagggaactccaataaataatggctgggtagaggaggacactgcaaggaagggagggaaagtgggctggaggagaaccacacaacatgctactgagagagctagaggaggacagtgttttcaaaagggtgggggagacttccagttccaaaatggtggtgtagaagcaagttgacttcattccctcccacaaaaccactaacaaatatacagtgctaaaatttacaccagaaacaacccagaactcaaatatgaggatgagtcagttcctaggactacagagaagtgaaaaaactctgaacagatggtaagaaaggcatacttcagcatctatgatacccctcctcccaattctgcctggcaccaagcacgtggaaaaactccccctaattcacggcttctacactggaaaaagtgagattgaggtggccaagagttttccccaccatctttggttccctggctggagacctgtccttgcctttaaccctttggaagcatcatgactgcctggagggaaaaacatccctgaggacaggcagagacaaaatcgggaggcaggactaccatcccaagccctggaaactctgcactgtaactcagcgaaaggcatgccaaaacagagtgactgttcagcagcaccacactgcaggaggaatgttccagaggttcctgggtataattcttttgctagccatctcatgccaatggaataaatcctttgggacctccctgatttgggacaggctgttctcgaattatttactaaacctggacttaaggtgccaccttggaagatgccaacaaggaagcagtgacccaacaatagagatttactaagcaaatatatccaataaaaagcaaagcaagccagacaaatcaaacaaacaaacaaaactagaataaataactaatcctttaatgcaaaaaactgatgtatacatacaagaaacaatagccaacaggaaaccatgacctccccaaaatgacaaagcaaaaatccagtgactgatcctaacaagatggcaatttgtcagctttttgaccaaaaattcaaaatagcagttttaagaaaactcagtgatcttcaaggtaactcagaacagcaattcagaaatttatcagagacatttaacaaagagattgaaataataaaaataacaaaaaaccccagaaattttggaactgagaaatactgaactcagaattgttgaactgaggaactcattagaggctctcatcatcaaaatggacccagcagaaggaaaaataggtaagcttgaagattggctacgtgaaaatacagtcggggaaaaaagaaaaaagaacaaagagtgcctacgaaatacagaaaattaccccaaaagactaaatctaagaatcagtggtctgcaagaggaaggtgagcaaaagcaagcagtacaaagcttatttaaagaaataataacagaaaagtttctaaacgtgagagagataaatatccaggccacagaagaaggtctgagaacatcaaacagattcaatccaaataaaactacctcaaggcatataagaattaaactctcaaaggctaaggacaaagagaagatatgagaagcaacaagacaaaagaagaaaataatacatacatgagctctaatttgtctggcaacagacatctcaatggaactgtacaggtcaggaaaaagagaaatgacattttcaaagtgcccaaagaaaaaagctgctatctaagaatatacatatatttttattgattgattgactgagatggggcctcgctatgttaaccaggctgggctcgaactcctggcctcaagcaatcttcccatctcagcctcccaaagagctgggattacaggcgtgagctaccattcccggcccatccaaaaatattgtacacttgatcttagccaaaaggccgagaagcgatcatccaagaatattgtatccagcaaaattatccttcaaatatgatggagagataaagtctttcccagacaaactaaagccgagagaatttaccaccaccagatccatcttacgagaaatgctaaagggagttctccaacctgaaagaaaaaaatactaatgtgcaaaagaaaacttttcaaggtaaaaaatacagtggtaaaattaagtacatggacaaacccagaatactctatgattgtaattatggtgtgcaatccactcataattctcatatgaagcctaaacgacaaattgatcaaaaacaataatagctacagcaacatgttaagataggtaatatgtaaattgagacatctcaagccaaaatgtggggggaatggagttaaagaatagaggatttttttatgttttttgcatttgtttgcttctccaagataagttgatccaagataagttgttacctctttaaaataacttgttataagattttttttttgtaagcctcatggtaaccacagtacaaaaacttattattgattcactaaaaataaagagcaacaaattataaaatactaccagagaaaatcacttaaccacaaaggaagacagtaagaaaggaagaaaagaagagaggagtctcaaaacaaccagaacacaagcaacaaaatgccagtagtaagttctaacttatcaataataacactgaatggaaatggtctacattctcccattaaaaggcatggagtggctgagtggataaagaaacaagacccaatcatatgcagcttacaagaaacccacctcacctataaagacacacagtctgaaaatgaggaggtggaaaaacatattccatggaattggaaacctaaaaagagtaggtgtagctacacttagaaaaaatagactacaaacctaagattgtaaaaagaaacaaagaaggtcactatataatgataaaggggtcaattcagcaagataatacaacctcccaagtatacaaatattagtaaatttaaagggagagatggaatgtaatacaataatagtaggagactttttaacatttcacttagtaatgaacagattatccagacagaaaatcaacatgaagaaacagtgagataaaactacatactagatctaatagacctagtagacagttacaaaaatattcaaccaactgctgcagcatatactttcttttcatcagcacaatgaagagtctgcagaacagaccataccttaggctataaaacaagtctgaacaaataaaaaaacccaaatcttatcaaatatctttcctgaccacaataataaaactagaaatcaataacaagaggaactttataaaatatgcaaacacacgaaaattaaacaacgtgctcctgaatgggtcaatgaaaaattcagaaggaaattaaaagttttactgagataaatgaaaatggaaacgcaatatactaaaatttgtggaagacagcaaaaacagtactaagaggaaagtttatagcaataaacgcctgtttcaagaaagtagaaagacttcaaattaacaacctaataatgcacttcaaggaactagaacaacctacaggagaggagaaaatatttgcgaactacccatctgacaagggattaacaagtcaatagcaaaacccccaaataatcccattaaaaattgggcaaaagatcttaacagacatttctaaaagaagacataaaaacggccaaaaggcattaaaaaagttcaatattaccaatgcaatcagaaaaacctcaaaaccacaatgagatattacctaaccatattcaaaatggctagtttcaaaacgacaagtgataacagatgctgatgagggtagagaaaggggaacctttatacactttaatggaaatgtaaattggtacagccactatggagaacagtacagaggttcctcaaaaaactgaaaatagaactaccatataatcctgcaattccactgctgagtatatatccaaaacaaaaacatcaatatatcaaagaagtatctgcacctccatgtttattatggcacttattcacaatagccaaaatatggaaccaacctaagtgtccatcagctgatgaatggataaggaaaatgtggtatacacacaatggaatattattcaaccataaaaaaggaataaaatcctgtcatttgcagcaacatggatagaaatggaggtcattatgttaagtgaaataagccaagtatagaaacacaaatattgcatgttctccctcatctgtgggagctaaaaaagtggatctcataaggatagagagtagattggtggttaccagaggctggaaaggacaggagggagatagggtgaaggaaaaataaagaatataaatgtacttattaccactgaactgtatacttaaaaatggcaaggatagcaaatcttatatgtgtattttatggcaacagaaaaaattaaaaattaattttttaaaataaaatggatggggagatcaacggagttaaagaatatttctaggtcaagtaataaaaggtttgacaatctttgtaaattatgtggataatatgatttctactacaatcactagagccaggcaatagatttttccagcctaaatcaaaggggtctattatgactaaatcatacataagtcacagaataattgcttcttaacttgtgatgtttcacaatccccagtttgagtcctttttcctatcactttaacaacccacatctcaccacaaacagtagggccattatcaattgagatagaagatttgacttttgttccccaactgacctgtgatgttgaatttaccttttccttatgagcttttggcatcttatgacaaacagtatcctcctccgaaaagtttctaattgacttaagctttacaagacatcctaggaccaaaggaatcacttgggtggcagcacgtacatatcaacagatcaaatgaaaacctaattagcgttgatccttgaacaacatagatttgaactgcacaggttcacttacacgcacagtttcttctgcctctgcctcccgtgagacagcaagaccaacccctcctcttcctccttctcctcagcctaagcaacatgaagatgaggatgaagacctatatgatgatccacttccacttaatggtaaatatattttctcttgctcatgactttctaataccattttattttctctagtttactttattgtaaaaatatagtgtacaatacatataaaatataaaatatgtgttaattgactatattatcagtaaggcttctggtcaagagtagcctattggtagttatgttttggaggagtcaaaagttatatgcagattttcaactgcatggagtcattgcccttaaacccctgcgttgttcaagggtcaactgtaaatatatttttcatatcagttaggggacatacaaatttcaaatatcctaaattagaagggaaggctgtttatcatctgggagcactgtttaaaagatgagagagaaacacaggagtctaaaataacatgactcctggagaacaaagtggaagaaatattaaaccagatacatattagtgcccctataataagcatgtctgtaagtagtaagttattgacgtatttagcaatctatgctatcttccttttttgtgtaactggtgttgtgatggataaagaagaaactgtcttgagcaactttctggaagaaaaagtccatagtatcctttcttgaggaaagaatttatttcattaaaaaatactcttatatcattctatacaatcacaaatgtttctcttcaagcaaagactcaaacactagctaattcttttacttttcctaattaaatacaaaaagggtaagtttttttaatttttaaaaactttaaaaaatgtttttactactgtaacccattattctgtaacaataatttaattaaaattcattaaagcaaaccagattacagttttcatatttccatgaaaaagaaaactactctggtttaagataaagataaatgggagtcatagattaatttagatctgagaatgaatatagagaatcttattattcatggaaaacaaaggagaaaatataccagcactttgggaggccaaggtggacagactgcttgagcccatgagctcaagaccagcctgtccaacatggcaaaggaatataaaaattagctaggcatattggtgtgcacccgcagtcccagctacctgggaggctaaggtggaagaattgttggagcccagggaggtcgagactgcagggagccgtgattgcgccaccgcactccagtctgggtgacagggtgagaccctgtctcaaaaaaaaaaaaagaaagaaaagaaaataacagatcaaactgaggaccacagatgtggtctctttattgtggcaactaaccagtggtgtttacatctgtggagttcccggaacccagaagggaagaagatggaataactaatgccagggggagagggagagagaaccaatccatataagaagtcagaaatacagacatataaatagatctagagaaatacacccaagagggggacaagatacaagcagtggcaaggagagattctacagacagatatgtaaaagaatataaatatgtgtatctcaggaatatgaaagcatgccctctaaaaaatttaaaaattgtattgaaatttcctaactataggcggaaatcaaacgtaacttgaatttttgagccagatgaaattaagcagtgttcactaagcttttggtaggagttgagtactcccttagtgggcatcctgctttaatggttaataggtctgggtaattgaccacatgctctgtatttaatatttaagaaagattaggctagtgaatgatgttaagagcaggtaatttttcaaagtccttgtgttcacaatgaggaaaactagggggaaatattgatagatcaacctacaatatttccacctggcttttgcttacagtcaacaccccctacccacccttgcccatccccggccacaactgctcccacccccatcctatgacttgtcttttagttccctgtttataattctaggtgaagacaagaaagactaccagtaatccataaaatataattctctgtggttaagtgcgagaggactatagaaatgaatgcttccaattctacattttggctgagttttcctttcagtcttaccttacaaagaccttgttggctgccagatgtgacacatagatccatttgtccttgactgggtgggtaatggatggtaggaggattatgcaattttatttgtaactgttttagccaggacaaaagctctggaattctaaagcaaaaaatgtatatttaaattcatagtagtaaaaatcatagtaacagtagtagacaggaaataataaatgacagctttatcaagcactttgtacactcaattaaaaaaccctcaaatgctttttgccagtatgaatattcctatttaaaagataggcagtagacttagagattaggaaattcctgtaagtcattcagccagaaattctcagaaagtcaattacgtaataaatgagctgagatttgaatctacatctttcttattccaaacctgaagtctttagcgcatgcgttgcataatcgattctttgttctctctaggaagagttctatggctacctagaagttcagactcaataagttgtttgtatcatggaatgtttgaataagcctatgtatatttaacatattacataactaacacatatatacatgaataacatttcaatacacttttcaatcacagaacaaagcaggttttaataaagtataatttatagattctctataaattatcctttatcacttgaagaagaccagctaagaaagtcaaggtatatgtttcagcttgcctttaagaaattaaagacatttgaacctatgagggcaatgtatttgaatggctgcttgtttagactatagaaatgaatgactatattcaatgtatttgcatgactgcttgtttagactatagaatgaagaaacggaagatccaggatgcttaaactttaaaaagttgaagcttcctggatcttccgtttcttcatttctcctgatatgtttgtttcacctggacatcttctcatttttttggactcagctctaatggtatttccttctagaagccttcttggtcatttgcgattgagaagcaatcactgaggagtgttaaacattcaatatcctttctgttcttaattatcctttgaaaacctttccccagaccttcctaaccattgaatactcatttggttagtattcaatgactgagtatttggtcattgaatgaccaaatgggtcaatggctttagaatatttatgaatggaccttagaatatttctttaatattctttatcaatgggccttagaatatttcttatgaaaataagccaataaaattatgttaagtattgatacttacccagcactcggagaatactgaagtgctctcttcatcatctcttctccaaattggatggtctttccattttctacagtgattacggcagtcttaaaaggaaacatgtttggatttggtaagccaccagccaaggagatcatcgattttggtcctctgctcaatatgtcagctacaatacacatggaagagaagaaacaatttcattgaagattgttataagcggatagttaagcatgcattatagtcaataaaactataaagtttaacgatttctagtgatagagtgtgctatggtctaaatgttggtgctcccccagattcatacttggaagttaatactaatgtgatagttttaacaggtggggtctctagaggtgattaggtcaggagggatccaccctcctgaatgggattggtgcacttataaaagagggctgagggaatgcccttggcccttctgccacgtgaggacataggttctcccttctaccacgtgaggatgcagcaagatggctctgtctataaggaagggctctcaccatggtgacacagaagctgctggcactttgatcttagacttcctagcttccagaactgtgagaaataattctattgttcataaattacccagtttgtggtattttgttatagcagcctgaatggactaagacaaaagctagtctaaaataaacatacagaataactttttctaggcacctcacttgtggagggactaaagaatgaaggtgaccaaagagaaggcagagggatcagaaagacagcaaagggccacaatagcagaagccctcctccacttagccccgacctgtctgtgagcttcatggcccacccctctcccatttacctggccctctccactgtacacccatctgcacgctgtgcatgccccttctcagcttcccaggaagagcctttcttgatagcacgccccctcccttccaaggccgtgccccacagcagtctgcgcctctctctactgttgctcctactctgctccagcagaaatacccgccttccgtttcagcccgagttctttgagaacaaaggctgtgtctatttcatttctgcacgcagagcctggctcaccgcgagcgtgcacaggggtacgcatggatgcaaccaagcggtggcttgctagggaaccctccttagaggctgtgcgaggaatgccccaccccaaaggagagatggtcaccccgtttctcactcatggtccggatgggagaagggtttctggctgcgctcgctgccgtgatgaaccgtgcgtaattcatgtcttctgacagccaagcatcaagcttcttcttcagtggttgaggactagaaaaaccaaagagcctcgtcaagtcctgcctgctaactcctcactctggcaacgccaccgcgagatgtgtccccccgctgcgtctggcttcccgcgcgcggtgcccggagaacgccgccgaaactccccggctggacgctgcgttcggtctcccggtcctaaacgggtctggggctgtgtggcgagcccggcaaagtccacgccgcacgcgctcctgcggccgccagggcccaggccggttttgccccgccgcgggcctcgccgcgccccctcccgccccgcgccgtggcctatggccgcccgcggcgcgcgcctccccgtcccggatcatcgccctcagagcgcagggcgcggggtagcccaggcgcgaggcgcttgcagccccaggccaatgactcttgacctcgccgctgggaatcaccgcaacccggcgtccgcgttggccggcctaggcgccggcccagaggctagcccaggggctgaccgaggggaccggaagtgcccgtgatcctaatcctcgggaaccatctggcggcgacttgggtccactgcagggggctcccgagctgcgcccagccgggagcggccccaccctcgttcccgcgcgctccgctggcctcctctcagtcactgggactgtgcattttgcccgctcagaccatggctatgctaaatacccatctttcgttagtgaaactctgggcactctcctgggaagcatcccggcgaccaagacgaatttcaacatcactttctcgaagatctcagcattttggagtgacgatggagttctgacaaaaatttttgaaaaatcactctgagtctcttcaattttagtgtctaccctcacattgaatttctgacctttcgttaaataagaattatgttggaagtgaatatccggatctttttgggtctagcaccttgcctttttttttcttacaaaataacccttcttactccccacctccctcaacttttctgcaatttctccttcctgaatcaccaaaatggaatgtacaaggtttaatgtgagcacttaatgagggaagggtttcagacaacctctctttgactttaaaaaattctttaatggttattaaaatgaatgaacagattcattcattcagcacaaatttactgagtacttcctagatgattattgactcactgccaaatggctctcttttaagtttacctaataggttggtcaaggagccactgcttttatctaggtcctggcagcaaaaggctgagataacccagtaaaatctttgtgctagcagctaaataacaaaaaggaagtattgagaggtgacagcctgctggcagccctcgcagccctcgctcactcttggcgcctcctcggcctcagcgctcactctgaccgcgcttgaggggcccttcagcccgccgctgcactgtgggagccccttcctgggatagcggaggccggagccggctccctcagcctgcggggaggtgtgtagggagaggcacgggcgggaaccagggctgtgcgggcgcttgcgagccagctagagttccgggtgggcgtgggcttggcgggccggcactcagagcggcgggccggctccgccagacccgggtagtgaggggcttagcacccgggccagcagctgcggagggtgtgcccagtctcccagcaatgccggctcaccggcgctaccttcgaattctcgccaggcctcagctgcctcccagcggggtgggactcggacccgcagccagccatgcctgagcctccccaccacccacccgtgggctcctgcgctgcccgagcctccctgacgagtgccgccccctgctccacagcacccggtcccatttaccgcccaagggctgaggagtgcgggctcacagcccgggactggcaggcagctccacctgtggccccagtgccggctccactgggggaagccagctgggctcctgagtctagaggagacttggagaacctttatgtctagctaagggattgtgaacacaccaatcagcaccctgtgtctagctcagggtttgtggatgcaccaatgggcactctgtatctagctaatctgatggggacttggagaatctttatgtctagctaagggattgtgaatacaccaatcagcactctgtatctaactcatggtttgtaaatgcaccaatcaacactctgtatctagctcagggtttgtaaatacaccaattagcactctgtatctaactaatctagtggggacttggagaacttttgtgtgtagctcagggattgtaaacgcaccaatcagcaccctgtcaaaatggaccaatcagctctgaaaaacaggccaattggctctctgtaaaatggaccaatcagcaggatgtggatggggccagataagagaataaaagcaggctgcctcagccaccagcggtaacccgcttggatacttttgcagcgtgtggtggttttgttttctcgcagtttgcaataaatcttgctgctgctgactctttgggtccacattgcttttatgagttgtaacactcaccgcgaaggtgtgcagtttctctcctgaggccgtggagaccacgcacccacagggaggagtaaacaaatccagccgagctgtcttaagagctgtaacactcaccgccaaagtctgcagcttcacgccagcagccagtgagaccacgaacccaccagaaggaagaaactcccaacacatccgaacctcagaaggaacaaactctggacacactgactttaagaactgttaacacaccgcgagtgtctgcggcttcgttcttgatgtcagtgagaccaaaaccccaccaattccaggcacagtatctagtaaacctgttagaaacccacgaggcaaaatgcttctgcgttcagagacttcaagtagttgaaatcccatttgatggcttaatagctgggtgtctttggacaagttaattaacctttctctgtattggttttctcgcaggcatgttgacaggaataaatgagataatctgtgttaaactaatcagtgcagtggtctgcacgttgtaaaaacgctatgaacattggctgttgttagtaacatgcatttaagcaaaccttaaggcctcagcctccaaatgtttttgactaaagctatttggcaacttttaaggcctgttctcagttaatccatgcacacagatccttatgtgtttgagcttgtccattctaaaagtagttcctgaatttttatagaagttaacaagcaccggaaacatctaaataaggtgtagatcaaggtaaattgtaacttgtaactagatatgttgatgttcctggggacttaaggcttttttttgataggggaggactctaactgagcaaggtttccttagatacttagaagaaaatttaaactttggccaggaggtgtggttcacgcctgtaatcccagcactttgggaggccaaggtgggtggatcaactgaggtcaggagttggagaccagcctgaccatcatggcaaaaccccatctctactaaaaaatacaaaaattagcggtgtttggtggcagatgcctgtaatctcagccactcgggaggctgaggcatgagcatttttcgaacccgggaggcggaggttggagtcagctgaagccgagatcacgccactgcactccagtgggggattgagctgggggatagagcgagactctgtctcaatttaaatttcttccatttggtagtaggaacctgttcggtcaaaggaatttggagtgctgggccaaggaaaagaccaaaggtttttgtaagcacgttgatgcacccgtctgtgatttgtagtatttattactcacaggctatttattttattttgagaggcagagtgtctagagtctcactttgttatccaggcttgaatgcagtggcgccaaccatagctcactgcagcctcgtcttcccgggctcaagcatttctctcacctcagcttcctgggtagctgggactacaggtgaacaccactacaccaggataattttttaaaataccttgtagagacagggtctccctatgttgcccagtctagtcttgaagtcctggcttcaagtagtcctcccactttggcctccggaagtgctgagattacaggcatgagccagcgcacctggcctcacacaggcatttttaaaaatacgtaattaattgatttttttaccccctttccaatcagtggtaacacaatttaaggaagccaaactgaagagctgtgagagcatcaaatcctaaggtgcaggttttcaacccttaaacagtttgctgaattttctatttggcctgtcctggagttgtactggtgagacggttgggggtgctgattgattgcaagctggctgatgattcaggccagatggagaggcagagaaatggcccatcagggcaggctaatggaatgcaggggcactggggggtcatgatcagcaaatgcaaggcagaatatagtcacagtggtggggaagggacaagcaagggttaagttgggaagagcttaccagacaatagaagctgaagactgaaggtaaatttgattgccagagaaactagactttggatttgtcaggcaccaacagcagaaggcttctcctgagggactaagataaatgagcaaggttcatagctcagtgttgcctttttagaagcttggcttaggactgcccaaggacggaattaaagacaccagattctttctccaaacatttactgaattcttactctgttctaggaactgtaattgatttaaaaagataactatgacaagtcactactcttgaaaaggaactgtttgtacattaagacatcaacaatttcagataatacaatgtttgtggcagaggcaggtacaagctgctaaggaaagcagagagaaggaagtctttttcttcttctcctctcccctcccctcccctctccttttcttttcttgagtatcccttatctgaaatgcttgggaacagaagtatttgggggttttggatttctttacattttggaatatttgcatatacataataagataccttggggatggaacccaatcctaaacatgaaattctcatttacatttcatatacgccttatgcacatagcctgaaagtaatttaatacaatatttaaaataattttgtgcatgaaacaaagttcatgtacattgaaccacccatgtaggccctctgtggttgtttggcatcatcatcattcctgactctgagtttatatgctactgataggcaatcattttcttataattattcacacatagtaattaacagtaaaatattttgttaatcattagtacagtgaagaaataatgtgtttaggtcaactgagcagcacagcagcatcagcacattacctgtatcagctgttaaacagcagtaacagcaaacaatggcaggagttcagtctctagatatgatgctgtgttttgattaaggttatgtagaccatattttatattttagatgagaagaaatgtcagaagcagttgaaggaccagaaagtgggtcccgtagggatgaggagtcaatctgctggatggattttaaaaatctgtcctccagagtcatctgcctcacctcattaacaatggtttttgtctgagaaggcactctttgatttcataagctgacatggtttcttgttctcttatacatgcatgctgctctagtgcttaaaaaagcccatcacagattttcaccatgtcagctatagacacttttcctgctgagttaacattatctttatcatccacttgtggcatcattttggtgctcaaaaagtttcagattttggagcattttggatttcaaatttttggattagagatgtgcaacttgtacaaataagatcacattcacacgttgtgtgtgtgcacgatttttgggagactattcagaccactatagtcaatgactaaaggagcctaatatgtaatagtctgagagattagaggacaaccagaagtttacagtgagaaagacagcaaaggaagggaatgttttgagaaagaccgaagggctcctaagaggataaacttatatcttttatcttgcaactccggggtcatagattcaattaccgctaactaatacgagtaacactcaattgctttaagactgttttgggttcttatgctagcccatgtctcatcaaggaataagcatgagattgtgtcttagtgtcttagttcatttagtgttgctaagcagaacacccgaggatgggtactttataaagaaaataggttgatttgactcatgattctgaaggctggaaaatataagagcatgatacttgcatctgatcagcttctggggagggccatgtgctgtgtcaagacatggcagagaagtggaacactgaggggacatatgcaaagagacaaacactaaaggctgggcttacttcataatgcctgttcttgcagtaacttatccagtcctgtgagagtgaaaacttactctcataagatggcatgaatcaattcatgagggttctgcctccatggtccaaagacctcctattaggctccacctcccaatgctgctgcactggtaattaaacttcatgagtttttgtggtgacaaaatccaaaccacatcacatagtaacttgaaaaaattgctattcataaatggcatctacctcagaaataattctttgagttaggtggacagccttgccttatggccaatatatccctattgaggttatgtatattggagatctcagtcattaatttgggtgcactttggagtgcagaagagaaacacaaaaataaccactggattctgatagagacagaaatgtactgaggtccgtagtgtaaccatcataatagaacggtcagtcaaagcttgagggatggcagatattacttgtcatgaaatgggtaggcaactctagaacttcataattaaatagaaatagtatcatcttagagaactgttcagaatcaacacccttgtgtgttgagtctatgggtatggtctttggaaagagacacaatatatctttagactgaagaccataggatgactctgtggaatgctgtccttgtcattcaggatgctggctgctcagctgttaaatagctaatgttcatttggtataatgccatttttctgttacatgcatcgtatgtaggatacttgtttatattatatgtattttaaatcttgtcagtctattcctcatttcttttaacatctttcatattttatgactctcactgtgctgtgtccttgtggattttgtagttatatttttcaagtattcatttttaaattcaattatttgtagttgtttgcacatttttctcagttgttttttcctttttttgaaaatagggtcttgctgtgtcacccaggctggagtgcagtggtgtaagtatggctcactgcagccttgacttcccaggctccagtaatcctcctatctcagtctcccgagtaactgggacaacaggtgcacaccaccatgcctgactaatttttgtagcttttgtagagacagggttttgccatgttggccaggctggtcttgaactcctgagctcaagcaatccacacacctcggccttccaaagtactgggattatggggatgagccactgcacccagccaagttttaaatgtcaatgaaaatattttttgtttctaggattctgatgaattcttttccatatttgtgattctttcacatattcatctgctttatttagattttgaaaaggggatatcattttcaccactaattctttcaggtcttaaatatacttgtttttaggcgtttctcatattgctttcttattttcatcttcatgagagtgaattcccatctgttgagacatatttcatagtgtctgctttccccatgtctttgacattttgaatgggtagtgttttctctcctagtactctctcctttcttctggcagtattcattgcttcctccaaaattccaagagaggtagaatcagctctgctgtagaggtttgtggctcttgtccacaggatgtcacagatgggctcccacagccttgggcagctccacctatgtggctttgaagggtatagccccgcttctggctgctttcacaggccggtgttgggtgtctgtggctttttcaggtgctggtgttgagtgtctgctttcacaggctggtgttgagggtctgcggctcttccaggtgcaccgtgcaagttgtcagtggatctaccattctggggtctggaggacagtggccctcttctcacagctccagtaggaagtgccccactgaggaccctgtgtgggggctcctaccccacatttcccttccatactgccctacttgaggttctccatgaggtcccccacccccacagcaaatttctgcctagacatccaggtgtttccatacatcctctaaaatctaggcagaggttcccaaacctcaattcttgacttctttccaccctcagactcaacaccatgtagaagcttccaaggcttggggcttgcaccctctgaagccatggcccgagctgtactttggctccttttagccacagctggagctgggacacaagggcatgaagtccttaggctgcacacagcaggggggccctggacctggcccatggaaccattttttccaactaggcctccaggcctgtgatgggaggggctttcatgaaggtctctgacatgccccggagacattttccccattgttttggtgattaacattcagctccttgttacttatgccaatttatgcagaggcttgaatttctccccagcaaatgggtttttcttttctatcacatggttagctgcaaaatttcaaaacttttattctctgcttccacttgaacacttttccgcttagaaatttcttccaccagataccctaaatcatctctctcaaggtcgaagttccacagatctctagggcaggagcaaaatgcctccagtgtctgctaaaggataacaagtgtcacctttgcttcagttcccgacaagttcctcatccccatctgaaaccacctcagcctggactttattgttcatatcactatcagcattttggtcaaaaccattcgacaagtctccaggaagttccaaactttcctgcatcttccgtcttctgagccctccgagtctctaggaagttccaaactttcccacatttttctgtcttcttctgagccctccaaactgttccaacctctgcttgttacccagttccaaagtctgcttccatatttttgggtatcttaatagaaataccccactctaccagtaccaatttactgtattaatccattttcatgcagctatgaagacatacataacactgggtaatttataaagaaaaagaggtttaatggactgacagttccacatggctgaggcttcacaatcatggcagaaggggaaggaggagcaaaggcatgtcttatatggtggcagacaagagaatgtgtgcaggggaactgccctttataaaattatcagatcttgtgagacgtattcactatcacaagaacagcatgggaaaaacacgcccccatgattcaattacctcccatgttgtccctcccatgacatgtggggattatgagagctacaattcaagatgagatttggatgggacacagtgaaaccatatcagtcctattcccttgcaggtgttgaaataccagaagtcatccaaaagattttaaataaagacaaatagttgggaaaaaaaaaagaagaagaagacatagtaacagtgctgtgttgagtatgttggagttggggcaaaataaaacatcctcgttccctatctctttgtatttaaatggttgatatttattcgtcttggaattgctgcttcaatttttacattttaaatattctatagaaattcattcattctgataactgagattttggtgccttttctaattttgtgctggaggctccttgcctccctagtctcatctggtccaggttcttcctccctgttcacaagtgaccaatgtctttgttttcttttctaggcttggaatattctcaatggctatcaaggccaccatgtggagcagtgcttcctggacctggtttcttcttggcatctggacctggcccagtgctacaggatcacctgcttcatctcctggagctcctgcttcaactgtgcccaggaaatggctgggttcctgagggagaatagacacatgagcttgcgcatcttcactgcctgcacctatgattaccacccaggatatgaggagaggctgcacatgctgcagggaactggggcccaaatttccatcatgacctctatgggtaagaatggaaactttgggtgggctggggtgtgttggggcagggagaggaaagttactagaaaggcagggagggtcggtatccctgtgcaaaaagccttggttggctgcctgcagaggcttatgaaattgctgttcataaatggaatccattcagaaacaattctttgagttagggtggacagcctatactgaggctcaggccctatagatgtgtgttttcatatcccagacaccactgtgtagttccattctatttctggtttcatatagatttctaaattgtttttgaactcacttttgtctttttatgttttaaaaatatttaatgccctattgtgttttgtgtttgaagtaaagggagaaaaatagatcagcaagtttctgcataaaatttgttgtggcaaattgttgctcttggtacctacttctacatgtgcatatatatacaggcatacctcatagatattgtgagtttggttccagaccattgtaataaagtgagtatctcagcatagtgagtcatgaaaattttttggtttcccagtacatgtaaaagctatgtttatactatactgtcgtttactaagtgtgtacagcattgtgtctgaaaatcaatatacataccttaatttaaaaatattttattgctgagtggagaggtggagcaagatggccaagtgaaccctccagtgattgtcccctcctacaggaacaccaaagtgaacaactatgcccacaagaaagcaccttcataagaactaaaaatcagagaagcaatcacagtacctggttttaatgtcatgtcaaggaaagaggcacgaaagagagtaggaaagacagtcttgaattgcctacatcacccctcccctttccctcagcagtggctgtgtggcatggagagagcatctgtgtgcttgcaggagggagagtgcagtgattgtgggatcttgcattgaaactcagtgctgctctgtcacagcagaaagcaacatagacagaattcagctgctaagtgcccacggagggaccatttagaccagccctagccaaaggggaattgtccatgccagtggtcagaaactcagttctgtttagccccacttaccatgagctaaagcactctgtagtcccaaataaatttgaaaggcagtctaggccacaaggaccgcaattcctgggcaagttctggtgcggtgttgggctcagagccactcacaggacttgcagtgcgtgtgacccagtgagacaccagctggggtggccaaaggagtgctagtgtcacccctctcctaactccagaaagcacagcttgcagctctaggagagactccttttggttgaggaaaggaaagggaagagtaaagaggattttgtctggcaactgggataccagcccagccacagtaacataaaacaacaagcagatccctgaagtctccattccaggccctagctcctggataacatttctagacccaccttgggccagaaaagaacctgttaccctgaaggaaaaaacaaagtcctggaagaactcaccacctgctgactaaagagcccgtagtccttgaataaacattagtagcagccaggcagtactcatcacagacctagaacagtgacggccatgggaaaagactctttttgaagaaaggagagggaggagtaaaaaggactttgtcttgcaaattgggttgcagctcagctatagtaaaataagacaccaagtagattcctaaagtccccagttctaggccttagttcctggacaatatttctagacccagtctgggccagaatggaagctgctatactgatgtgaaggactcagtcctggcaggattcaccatcttctgagtaaagagcccctgggcctgaaataaacatcagtggtagctaggcagttattgccagtggcctggtgatggccatgtgaagagattccttctgcttgaggaaggaagaggaaagagttaaaaggattttgtcttgcaacttcagtaccagctcagccacagtaaaatgaagctccaagtagattcctgaagttcttcaatccaggccctagttcctggacatttctagacccaccctgggccagaggggagcttactgtactgaagagacggactcagtcctggcaggattcaccatctgctaactaaagagtccctgggtcttgaacaaacatcagcagtggccaggcagtagtcgtgaagggcctgggacagcggtggccatggggagaaactgtttctgcctgaggaaaggaaaagaaagagtaaaaaggactttgtcttgcaacctgggtactacctcagctacagtaaaatgaagcaccaagtagatttctaacattcctgattctaggccctaattcctggacaacatttctagaccctctcctgtggccatcaccatcccaggccccgggcaactactgcctggctacaactgatgtttgttcaaggcccaagggctctttaaccagcaagtggtgaatccagccaggactgggtccttccctttagatagcaggctcccttcttgttccagggtagacagaggtgggaggattgtttgagcttttgagcctgggaggcaaaggttgcagtgagccaagattgcatcactgcattcaagcctgggtgacagagtgagactctgtttcaaaaaaaaaaaaaagaaaaaagaaaaaagaaaaaaaagaaaagaaaaagcaatgaaatgtttaaaaaatgaaaattaaattaaaaaaaggaaaatgaaggaaaaggatgttaatgagcaatcagagatcatctgaagctacaaaactcactggtaatagacaaatacagaatattataataccgtattgtagtgtgttaactactcatatcttgagtagaaaggctaaaagacaaatctatcgaaaataactacaacaactttttaagacatagacaaaataatgatatataaatagaaaaaacaaagttaaaaagcagggtggaagatgaagttaaagtatagaggttttattagttttttctttgcttgtggtttgtttttgcaatcagttaagttgttatcagtttaaaataatgggttatagaatgtcattaagcataatggttacttcaaataagcaacctacaacagacacacaaaaaatgaaaggcaagaaattaaaacataccaccagagaatatcaatttcacaaaaaaggaaggcaagaaagagagaaggaagacaggaagaagggaaggaaggaaggaaggaaagaatgaaggaagaagaaagagaaggccacagaataagcagaaaacaaataacaaaatggtagtaagttctgatttgttaatgataacattgataaagttgaaggtaaatggactaaactctccaatcaaaagacaaagagaggctgaatggatgaaaaaaagtaggacccaataatgatctgttgcctacaagaaacacacttcacctataaagacacgcattgactgaaaataaagggatggaaaaagatattccatgctaatggaaaccatggaaaccaaaaagagagcaagagtagcaatacttatattagataaaatatatttcaagacaaaactttagaacgagacaaagaaagtcatcatataatgataaacggaccaaatcagaaagaggatataatagttgtaaatagatatatgtatccagctgtggagcacccagatacataaagcaaatattattagagctaagaagagagagatagaccccaacacaataatagctaaatacttcaataccccactttcaacattgggtagataatccagacagaaaatcaacaaaggaacaaccgacttaatctgtactatagaccaaatggacttaataaatatttagagaacatcgtatccagacactacagaatatacactgttctcctcagcacgtggatcattctcaagaatagagcatatgttaggccacaaaacaagtttttcaagaaattcaaaaaaattgcaatcatatcaaatatcttctctgaccacagtgggataaaactagaaattaataacaagagaaatgttggaaactatacaaacccatgaaattacacaatattctcctgaatgacccctgaatcaatgaaaaaattaagaaggaaattaaaaaatttcttgaaacaagtgaaaatggaaaaacaacatacaaaaacctatgggatacaataaaagccatactaagagggaaatttatagcaaaaagtgcctacatcaagagtagaaaaacttcaaataatctaacaatgcatcttaaagaactagaaaagcaagagcaaaccaaaccccaaattagtagaagaaaagaaataatgagtatcagagtataaataaataacacttaaataaaaagtgccaaagatcaacaaaataaaaagttgtttttttgacaaaacaaaaaaattaacaaacctttagccagactatgaaaaaaagacacaaataaataaaatcagagatgacatattacaattgatactgcagaaattcaaaggactttaagcaacttatatgccaataaattggaaaaccagaagtaatggataaattcctagacacataaaagctacaagattgaatcatgaagaaattaaaaacctgaatagaccaataacaagtaatgagatcaaagctgtaattgtctcccagcaaagaaaaccctgagatccaatgacttcactgctgaaatcgaccaaacacttgaagaagagctagtacaaatcctatccagctattctgaaaaatagaggaggtgggaatactttcaaactcattctatatggccagtattgccctgataccaaaagcagacaaaaacacgtaaaaaaaagaaaacaatgagcctatatttttgatgaacatcaatgcaaaaatcctcaaaaatacttgtaaaccaaattcatcagtgaattagaaagatcatttatcatgaccaagcagagtttacctcaggggtacaaggttggttcaacatacacaaatcaatcaatgtgatacatcctatcaacagaatgaaggacaaaaaccttataatcatttcaattgatgctgaaaaagcatttgataaaattcaacatcccattcatgattaaaaaaaccctcaaaaactggggatagaaagaacatacctcaacacaataaaagccaaatatgacagacctgcagttagcattatactgaacagcaaaaaactaaaagtttttcctctgagatctggaacatgataaggatgcccacttttaccactgttattcaacatcgtactggaaatcctagctacagcaatcggtcaagagaaataaataaaggccatccaaattagaaagaaaaaagtcaaattattcttgttttcagatggtatgatcttatatttggagaatcctaaagatgccaccaaaaaactattagaactaacaaacaaattcagtaaagttgcaggatacaaaatcaacatacaaaaatcagtagcatttctacatgccaacagtgaacaatctgaaaaagaaatcaagaaagtaatcctacttataatagttacaaataaaataaaatgcttaggaataaacttatccaaagaagtgaaagatctctacatagaaaactgtaaaacattgatgcaagaaatttaagagaacaaatgaaagaaggaaaagaggagctgtattagtctgttctcgcactgctataaggacatacgtgaacctgggtaatttataaagaaaagaggtttaatcagctcatggttctgccagctctccaggcttctgcttatggggaggcctcaggaaacttacaaccatggcagaagttgaagaggaagctggcacatccaccatggctggagtaggagaaagagagacaggcgggcaggtgctacacacttttaaacaagcagatctctggagacgtcttatcaccagacagcactagggggatggttctaaaccattagaaactgcccacatgacccaatcacctccaagcaggcccctcctccaacactggggattaaaatttgtcatgagatgtgggtggggacagaaatcaaaactgtatcagaaggctaaatggcaaataattattcttgttatgctttgtgcaaacaaccaggccacgtatattaagactgaagcttatttcacaaacaaatcagtcctatcatgatttgtttttaataaaaatgaggattggagagagaaaaattatgtttcaagaattacagtacacctgtatttagattctagtctcatcagttatttttgagttttgtcagcaatttagactaacccttcttattcctgtgaaacaatcagtgatctctggctgcagctcagaagaaaagatggatgggtagtgtaaaaatctggatcaatattctaattctgggcatgtattataatcagctagcaactccatgcacccaagtcttagcaggtgtgactatacccaccagctacctaggtgtgttggtagccctaggattttttggagctgttatcttcctcttttttttctttttaaccattcttctaaatctgataacttgatttgtccccttttaccttcaggtcatcaagctccagatgatcctcagtgaaggatactgacctctcaaatattcaagagttacccttctatagcgggcctctagactgcccatcaatgggacacaacagaggcaaaatcttgcccctgtctcccttaggcctggctggatactgcttttttacaacccatagagccaaccctgccctgacagctagtaggaggccaagacccacagaaccaccaccaccgcccctctgtctgcaggaagcagttacagaagactgaccttcatccattttccccaaagaattggagtcttggactccagagggggaaatgttatagcaggtagctagttaaacatgagcagggcaggacagggctcccaacccccaccaggaatgtcaggcgacatcaagtgatctctcaagtcacccactctgccctcttccaagtgtactttacttcctttcattcctgctctaaagcttttaagtaaactttcactcctgctctaaaacttgcctcggtctctccttctgccttatgcctccgtggtctaattatttcttctgaggaggcaagaactgaggttgctgcaggccatatggattcactgctggtaacatgttgactggagtagcacttttaattttcctccagaacttttcttttgtatttacaattgggctaattgtctgatgcaagagttttagcttttagcctctgccagcctttgacatgccctcctcactaagctgaatcatttctagcttttgatttcaagtgagagacatgactcttctttgcacttgaacatttagaggctattgtagggttcataattggcccaatttcaatattgttgcatctcagggaatagggaggcctgaggagaggaagagagatgtgggaaatggctggagggtggagtagtcagaacacacatactgtctatgtattaaatttggtgtcttatatgggtgtaaatcttgttgcccccaaacaattacagtagtaaaatcaaatatcgcttatcacagatcaccataaaagaaataacagtaatgtaaacatttgaaatattgtaggattacccaaaatgtgacacagagacacaaaatgagaacatgctcttggaaaaatggctccgatagacttgcttgatacagggttgccacaaatttttaatttgtgcaaatcatagtatctgtgaaatttaataagctaaacacagtaaaataagatgaacctttattgtgcataaatagataattatttgggggtaattcttcacatatgtaatgaatatttttgtagaaaatgtacacatgacccaatcatttctaaggaagataaagagttttaggtaaggctaatatggaaaacagactaacctgaatctaccagatagaggaactgctgctaataaattaaataaaataatttttataaattcaagagccttgaaaacactaattggtccactaaaatgttacagattttaaaataaatcttgggcaatatgtcaacaaacaggtagactatatgacaattcatttgtcaaatctagtatcaaataaaggaaatgaaaattgaaattgagaatattttatgttagaacacgttaagaaaggatctagtaaagcaaggattagattggagttatgattttgaaaatctctttgtctctgaaacagcccaggcaggctcgctgatgtcatctttttgggcgaataattattatatagttagaaagctcagggtctgatggttaacccactgcatatctctacccaaagaatgggggcttgcccatagggttggcgctcctgaagcatgggtcaggaaagcaaagatctttttcaaggatatctgggggtagtgttggaacgacaaggccttcagcctagaaaagggcttcctctgtaagtgtggccatcagtgacaaagaaaatacaaaatcaatgatataaccaacgagaacaagccaaaaagaggcttgtatcaataataataaaatttaaatactctatgcaaaaggttttaatttttatttatttttgagacagggtcttgctctgtcacccaggctgaagtgcagtggtgtgatcactgctcactgcagccttgatttcccaggcaccagggatcctcccactcagtgctcctgaccccccaggtagctgggaccacaggtgcgtgccacctgcctggctaatttttgtatttttggtagagacagagtttcattatgtttcacaggctagtcttgaattcctgaactcaagcaatccacctgcctcagcctctcaaagtgctagaattgtaggcgtgagtcaccgccgcatccagccaatttttataaggcatgaagtttaactattattattagtaatagtagaagagaatgctgtatgttgatttaggagtgttttggctaaaatctgaattaacaatttaaggtacctttgttttacaagatattagacttagtcatatgggttcacagcattccactgaagtttcagattgtgctctgagaaacagcctgcttagcaaacttggggaaaaaaattgctaagacctggaataagatattaaaataacagaatattttaataatatctgggagaagggaaacagacatgaatgttgtgaattttattattataacatttaaaaaatgcaggatgatctatttgtatttttttcaagtctcctcagtgagtatgtatactcgtagaggtaatagtagaaattgtaactgacgatgcaaccatggcattaatccattcgaacatcttgcatccagacaatgggatttgttgaacaatagggaaatattctcacttgacaggttttaggattttgttgtggctgttgttgtttttggatatgtgggtgttggcaggaatagcttcgttaacacattacattgatttccagagttgacttggtggacctggctggcagggtatttgggtgtttctttcctttctattgctccttgctggttgctatggcagctgtattcctgtgaagagagaatgcctgcctagtgtctgtctgttcttgtttcaatcagaaaagcatgtggagcctttccaaggcaggctggatcttacctatgatgtatcggtagtgcatgaacatgccatggtcagcactgtccaccttgcagtgtgcctctgggacgtgtcctgagatggatgaggttttcagtttgcactttttgagattccgtggtctgctttttagaaacccatacagtattacagccattgcttacagaagctgtccactttaaatagcgtgggtttgaaaattgagaccagagctgcttaaaagactccagagtataactgagataatttgttgcacatggatgggtaaaataggaaagagtaggaggaagggagggagatgattgcataaggagacagaaaagaagtctgtgtagggcagtgactcagaaaaatgacttaccagggcaaaggactcatgtataataattgatctccaattcatctgcttctgtgaggtttactacagatgtccgttctggttttaattcaccacttcctaccattaccctgtgaaagaaaaataaaaatcgtgagactctagattcactatgccaaaggggaaaaattaagcttgaaaactgagtcatgccaaaacaacaacaacaacaacaacaaaactgcctttccttttgttcctaaaccaatagctacagggtagaaggtcacgtatctctgcaggtgacctctctcatgctgacaatgtaaatcaacagcttatcttcacaggcatgggacaagaggagactagaaatcatcccctcaccgaacctgagacaaatccctatttgacttttctctgtactcactatgtttatcttttgtaaagtgcaggtttactaagcgtgagacgctaagcatgagacaaatacataatttattgttccctctaccacctccttttcatgtacaacatgtggattcattgagctctaatcaaagcctcacaagatgtgaccataccttcctccctctttttttcttttccctcctgcctgttttttcccctttaagtgttgaaactctcaaaatcctctttggaaaaagtatggaccacagatcttactgtggtttgtgtctctttttcctgtgtgcatcctcaatcttggcaaaataaacctctaaattaattgagattcatctcagccattctctttggttttacaatgctgtgcaggtttatcacagtatctacaacattgcttataagcatctctctttccaatagttggtaaactacttgagggtagaaactctttgaaggaaattaaaatattttaccccaaaatatattcctttgacatgtttaaaaatggctgccacttggccatgctgtcagaaatagcactgcacagctgtcttaagtggggagaatttgcatctgtagagaatccccatgaaagtaaccttgcctccctccctttcctatgcctttccctggatccaggagtgactgacagtctgacaccttttaaagcctgaaaagaaacatttaccatctgttccctctgagggaggcttcgtccacataacaaggccatctttgctagccaagcttctttctttccttctgtcttaacctgtcttgccactaaccctgattcacctgtttctggctgtgctctgagtctgtgtttcttactgtggcctcaggatggtatataagtttccgtaactctctgggaatttgggtcttcacaccgaaggctcccttatatatacattaaatacatttgtatgccttttctcttattaatcaatctgcctcctgtcagtgattttagtgatcatttagggggcgaagagcgtatcgtcccctacagaacaggatgatcatcagagttgctcttctcttctagaggctacagggaagagaaacaagagactgatctgctggcaaagggataaaaatttcctaccaactaggctactggcctgtctttctctgtgtaccccagtgagcagatggtaaaaatcccagtctcatctgcaaggttttgattaacaggaaaaaggaatttgactagtcttgcattgtagtgtcctggtgtactttcagtactttgtggtatgaatactcatattgtgtgaccccttttctctcagaaatagccttttctgttgccattttcctttgtctttctgtgttgttctgtcataaagaggggtagcattggatagaacatgggcctagaacccctttatgcctgctgttcaagctgaccctgcatactggtcagtttttacagttctggatagaccagcatgtgttcacacaaacttttctgtgagtccctgatacaaaaatcagatgaggtttccctctcatcttgttttatgtccttaagaacttgactttatggctacatgggggtactctctcttagtctctaccatctgggaatgtctttttaaaaatttaaccttttcatcaattgtttagaatagagggcatgaattttttggttcacattagatggacagtctgaaaagactgggaatctgataaacataatattttaagcaagacactttttatactgaatgtgtcacactctcagggaaattttgtctacaagacccatctctatggagcttttgtgatcttttgtctatcttaactctatttttcagagtggatttttgggagtcatgaggatgtctccttcatgccctctccaggaatgtaaaacctgaaaaattaccacttgggctttaaagaggcttttgaatttagttgctattggaataaagtacaccattgaaaattctaattgccaatggccagaagataaattaaaagaaagatttttgagacctgttattctaaaccattgatgaaaaggttaaatttttaaaaagacatgtaatagtgttatggctagccttaagaaatttttttgagaaaaatttgccatagttaagtcatagccttagtttaggcttattgatttcacctaggaagttacctttggtaaagaagttcaaaaatcagaaatatcagctgtttgtcctgactaaaatctgataataagagatttgaaagaatttttaaagagttctgtagtcaaaagtcaacttaattaaaacaggtatttaggctacatgtgtatctatattgttttaaagcctctgttctctctctgtataaacttctcagtgaattctgtctgttccaccatttacttcttcctatcttcctcccactttctatcctgtatgccacacgagggacctaaaaatacaaaaggaatttctaactgcccaggatcccctgggaaaaatggaaaatgtaccagactcctgtgtctggaaggaaactctgattttcttcatgaaatcccaagagttgtaaacggacagattccactcagatctaaaagcttttctctcttttgtattgcattccctaatctttttggcttttggggaattgaaaattactttgcattatgaaaaaatttttgacattggtgtttgtaatagatatactttctgagatggctaatggtagttgcttagagcaaacagttattactacaggggatactctgtgtgtttaagataagaaaggacatggtttaaacacttagacaaatgtcttcatgacaaaatgtgctctaaaaatattatgtgacctggccctgtggtatttttctctttttggggattcagaattcagtgtgggctctgctctgggctcagtggtccagttaaaagatagtaaattaaaaaacacctatctaaataaaattggtctgacaaaatactatgatagagttctatgattttgtgctgtcctgacatccattttattatttaattttattttttgagacagggtcttgctctgttgcccaggctggagtgcagtggcatgatcttgccttcctccaacctctgcctcctgtgctcaagtgattcttgtgcctcagacaccgagtagctgggattacaggtgctcaccaccatgcctggctaatttttgtatttatagtagagacaggatttctccatgttggctaggctgctcttgaactcctgacctcaagtgatctgcccaccttggcctcccaaagtgctgtgattacaggtatgagccactgtgcctgaccgacatccattttaaaacttcctctaacacactcaaactctctctctctgatttgagatgtaaatttgctatcttgttttctccaaaactcagtgagggcattagtcatggccatgataaataaattttaacattttcacaatttaatccaactgtctttttagactagtgagtgtatctatcttatggctaaaattttaaaatcaaactataaagtcctggataaagaaaatgtggtacatatacaccatggaatgctatgtagccaaaaaaggatcatgtcctttgcagggacatggatggagctggaagacattatcctcagcaaactaatgcaggaacagaaaaccaaatactgcatgttctcacttataaatgggagctgaacaatgagaacacatggacacagggaggggaatgatgcacactggggcctatggggaagtggttgtgggagggagagcatcaggaaaaacagctaatgcattttgggcttaatacttaggtgatgagtctattgctgcagcaaaccaccatggcacacgtttacctatgtaacaaatctgcacttcctgcacatgtaccctggaacttaaagtaaaataaaaactataaagtctttatgttactataatctttatgtgtacatgggtatatgtctgtctgtatactgtctgcatgggttttaaattgacttactcataaataaagtagataatcctaaatgcttttcaagttcatatgattttagtaatttttggtaaataaagatagttttaaaattatcggtaaaataaaatagaagcatgttcagaatttagacatttgacctgaattagtcactgtctctgatgttttaagatgcaaaactttgctcctgatacttgcttaacttgtctgtaacttacgtgcttagatttgtgcctttaggatatgaagcctagctccaggcatcgttctttgctctgggttatgtacctggtacataattaaaattgcttacttactaggttttttcactaaaataagagttactgagaattaacattacaattaatacatgtaatgaacgttactagatatatacaaagtgtgtaagaaaagtaagatgtatttttggcaaaaaaagttaaaagaaggcatgagaatgttttttttttttttaataaggggaaggaattttgtctagtttaagggtttttaaggattcttttaagttataaatagaacaaaatggaaggtgtttaagcaagttggggaaagtttgagaaaagattgatcttgtaaaaggaattctgtatgtgaacgagtttgctaaaatttgaaggggattatttagtttttctataaattaagcattaaaataaaaagcacagtgatggagagccagtatctgggctgctgtgtctgaataacagagttttcttggagtcttgatctatctgctttttgacaggaaattataaaaggttatagaaggcttatgacaaccttatattatggccaagttcattaaagttagatttgttcatttggttttattaaaattagatttagtgctaataatacactacacaaaggtaaaaattggttttctcttgaacaaaatttttgtttaatattaagagatagtaaaagatttctgtttaccttttgagtaaattgcaaaagagcgagagacagatttagttggcctcatgctgtgtctattaggtcttattgtttgggaagtaagtctccattctcaaagagtaaaggtttttgctttttgaaaattttaagttattattttgggtaaatgattgatttattttacaatgactcatgattctattttgtgatatagtgttctaaaccttcaatatttgacaactattccaaaatcaaattctagattcaaacttttgacctcaaactaactttatagaagtctaagagagagagatttagcttaattaatatgttaaaatcatacaggaaacattgtcaaaaataaaactgtgttcaactttttttggtttatatttatgtaaatgtgttattagtatgtgttccaaaattgtgagatttctgtaattctgatacatattagtatacgttatcagtagtaattataattattatgttaaattgttatataccacagaaataaccaaatttctttgtcaattgtgtctttgaccatgactgctctaagacttttgttatctaaaattattttactgtgatctttttaaaaagacagcttaattataaactaattatagttaaaggattcttacagatgctcttgaatgcaggtttctgataactttagaaatttgccattggaatagagaaaaaagcatctaggactcatgatgtgttcatgaggcttgctggcccaatactgagcagaacaggggcaaaccgtgaaactgcctttgcaaaaattataactgaagaaattgtgacagtgaaagagatcagacctaacagactctatcttgcttctaacctctaagctgttcttgttcattcctgagtgtcaggcctctgagcccaagctaagccatcatgtctcctgtgacctgcacgtacacatccaggtggctggttcctgccttaactgatggcattccaccacaaaagaagtgaaaatggcctgttcctgccttaactgatgacattgtcttgtgaaattccttctcctggctcatcctgactcaaaagctcccctactgagcaccttgtgaccactactctgcttgccagagaatgacccccctttgactataattttcctttatctacccaaatcttataaaacggccccacccctatctcccttcgctgactctcttttcggactcagcccgcctgcacccaggtgattaaaagctttattgctcacacaaagcctatttggtggtctcttcacacggacgtgcatgaaatttggtgccatgactcggatgggggacctcccttgggagatcaatcccccgtcctcctactctttgttctgtgagaaagatccacctatgatctcaggtcctcagaccaaccagcccaagaaacatctcaccaatttcaaatccggtaagtggcctctttttactctcttctccaacctccctcactatccctcaacctctttctcctttcaatcttggtgccacacttcaatctctcccttctcttaatttcaattcctttcattttctggtagagacaaaggagacacgttttatccatggacacaaaactccggcaccggtcacggactagggaaggcagccttcccttggtgtttaatcattgcagggatgcctctctgattattcacccaggtttcagaggtgtcagaccacgcagggacgcctgccttggtccttcacccttagcggcaagccctgcttttctgggggaggggcaagtaccccaacctcatatctctgcaccccgatcccttatttccgcgctctgacctcttatatctctgtgcccgatcccttatttccgcgctctgacctcttatatctctgtgccccgatcccttatttccacgctttgacctcttatatctctgtgccctgatcccttatttccgcgccccaacctcttatatctctgcaccccaatcccttatttccgtgccccaacctcttatatctctgtaccccaatcccttatttccacaccccgaccttgtatttctgtgccccaaacccttctctgcttttctggagggtaagaacccctgaaccccttccctccgtgtctctactctctcttttctctgggcttgcctccttcactatgggcaactttccaccctccatttctccttcttctcccttagcctgtgttcctaagaacttaaaacctcttcaactctcacctgacctaaaacctaagcatcttattttcttctgcaataccacttgaccccaatacaaactcgacagtagttccaaatagccagaaaatggcactttcaatttttccatcctgcaagatctaaataattcttgttgtaaaataggcaaatggtctgaggtgcctgacatcctggcattcttttacacatcggtccctccctagtgtctgtgcccagcacaactcatcccaaatcttccttctttctctcccgcctgtcccctcagtcccaaccccaagcgtcgctgagtctttctaatcttccttttctacagacccatctgacctctcccctcctccccaggctgctgctcgccaggctgagctaggtcccaattcttcctcagccttctctcctccgctctataatccttttaccacctccccttctcacacccagtctggcttacagtttcgttccgtgactagccctcccccacctgcccagcaatttactcttaaaaaggtggctggagctaaatgcatagtcaaggttaatgctcctttttctttatcccaaatcagatagcgtttaggctgtttttcatcaaatataaaaatctagcccagttcatgactcgtttggcagcaaccctgagacactttacagccctagatcctaaaatgtcaaaaggccgtcttattctcaaaatgcattttattatccaatctgctcccgacattacataaaacttcaaaaattaaattccagccctcaaaccccataagaggatttaattaactttgccttcaaggtgtacaataatagaaaaaagtcgcaattcttgcctccactgtgagacaaaccccagccacatctccagcacacaagaacttccaaacgcctgagctgcattggccaggccttcctccagaacctcctcccccaggagcttgctacaagtgccagaaatctggccaccaggccaaggaatgcctgcagcccaggattcctcctaagccgtgtcccatctgtgcaggaccccactggaaatcagactgtccaactcacctggcagccactcccagagcccctggaactctggcccaaggctctctgactccttcccagatcttcttggcttagcagctgaagactgatgctgcccaatcacctcggaagccccctagaccatcacggatgccgagctttgggtaactctcacagtggaaggtaagtccatccccttcttaatcaatacggaggctacccactccacattaccttcttttcaagtgcctgtttcccttgcctccataactgttgtgggtattgacggccaggcttccaaacctcttaaaactccccaactctggtgccaacttagaccatactcttttaagcactccttttaattatccccacctgcccagttcccttattaggctgagacactttaactaaattatctgcttccctgactattcctggattacagctacatctcattactgcccttcttcccaatccaaaacctcctttgtgtcctcctcttgtattccccaaccttaacccacaactataagatacctctactccctccttggtgaccgatcatgcaccccttaccatctcattaaagcctaatcacccttaccccgctcaatgccaatatcccatcccacagcatgctttgaaaggattaaagcctgttatcactcgcctgctacagcatggccttttaaagcgtataaactcttcttacaattcccccattttacctgtcctaaaaccagacaagccttacaagttagttcaagatctatgccttatcaaccaaattgttttgcctatccaccccatggtgccaaacccatatactctcctaccctcaatacctccctccacaatccattattctgttctggatctcaaacatgctttctttactattcctttgcacccgtcgtcccagcctctctttgctttcacttggactgaccctgacacccatgaggctcagcaaattacctgggctgtactgccacaaagcttcacagacggcccccattacttcagtcaagcctaaatttcttccttatctgttacctatctcagcataattctcataaaaacacatgtgctctccctgctgatcatgtctgattaatctcccaaacctcaatcccttataaaacaacaactcctttccttcctaggcatggttagtgtggtcagaattcttacgcaagagccaggactgcaccctgtagcctttcagtccaaacaacttgaccttactgttttagcctagccatcatgtctccgtgcagtggctgctgccgccctggtacttttagaggccctcaaaatcacaaactatgctcaacttactctctacatttctcatcacttccaaaatctattttcttcctcatacctgacacatatactttctgcttcccagctccttcagctgtactcactctttgttaagtcccacaattaccattgttcctggcccagacttcaatccggcctcccacattattcctgataccagacctgacccccatgaccgtatctctctgatccacctgacattcaccccatttccccatttttccttccttcctgttcctcaccctgatcacacttgatttattgatggcagttccaacaggcctaattgccacacaccagcaaaggcagactatgctatagaacaagccactagcctgccttttagaacctctcatttctttccatcgtggaaatctatcctcaaagaaataacttctcagtgttctatctgctattctactactcctcaggggttattcaggccccctcccttccctacacatcaagctcgaggatttgcccccacccaggactggcaaattagctttactcaataagccccgagtccgataactaaaatacctcttagtctaggtagacactttcactggataggtagaggcctttcctacagggtctgagaaggccaccgcagtcatttcttcccttctgtcagacataattcctcagtttagccttcccacctctatacagtctgataatagaccagactttattagtcaaatcagccaagcagtttttcaggctcttagtattcagtgaaaactttatatcccttacagtcctccatcttcaggaaaagtagaacagactaatggtcttttaaaaacacacctcaccaagctcagccaccaagttaaaaaggactggacaatacttttagcactttcccttcccagaagtcagacctgtcctcagaatgctacagggtacagcccatttgagctcctgtatagacgctccttttcattaggcccaagtctcattccagacaccagaccaacttagactatgccccccaaaaaacttttcatccctactgtcttctgtctagtcatactcctattcactgttctcaactactcatacatgccctgctcttgtttacactgccagtttacactgtttctccaagccatcacagctgatatctcctggtgctatccccaaacttccactcttaactcttgaagtaaataaataatctttgctggcaggactatgttgaatctccttaggcactctgtgatcagatgtcctgggtcctcccaattcttagaccttttatacctgtttttctccttctcttattccatttagtttttccattcatacaaaaccatatccaggccatcaccaataattctacatgacaaatgtttcttctaacaaccccacaatatcatcccttaccacaaaatcttccttcagcttaatctctcccactctaggttcccacgccacccctaatcccgcttgaagcagccctgagaagcatcgcccattatctctccataccatccccaaaaagttttcaccatcccaacactttaccactatttcattttatttttcttattaatataagaagacaggaatgtcagacctctgagcccaagctaagccatcatatcccctatgacctgcacatacacatccagatggctggttcctgccttaactgatgacattccactacaaaagaagtgaaaatggcctgttcctgccttaactgatgacattgtcttatgaaattccttctcctggctcatcctggctcaaaagctcccctactgagcaccttgtgacccctactctgcctgacagagaacaacccccatttgactgtaattttcctttatctacccaaatcttataaaatggccccactcctatctcccttcactgactctcttttcggactcagcccacctgcacccaggtgattaaaagctttattgctcacacaaagcctgtttggtggtctcttcacacggacgtgcatgaaactgagtgtaggccaagttagccttgggaaaggatttagtttatagtttaatcctgaaacaaaactgttaatagccctttcctgaaaaaactccctttttgcctatgaatcagtctgcctttgtaggactaacaaatcagctacaagattagaaattaccatttaggagccttgcagcctctggctgcaagagtctcaacctcctcaaattgctcctgggattaacatcactgttgtaaaacctaagatcagtgcttaagatatttcacaaaccctgcattctgatgtaccagctgacatggcccagaccagtaatctggctcaaccagttctgcaatcccacacaggaacagatgtcagcaagaagaactcatctcagccccttatgatttcatctccagcccaatctatcagtactcctcacttcccaatcatctacccaccaaattatccttaaaaactccaatcccaagttttcatttttggggagaccgattcgagtaataataaaattctggtctccccacacagcttggtctgagtgaattactccatctccattgcaattctcctgtctcaataaattggctctgtctaggcagcaggcaaggtgaacccatggggcagttacaattgcatggactgagctaatagaagactgaaataatttttttatgacttcttgtgtttgaaacattgctaattctttttgttttacagaatcaagaaaatcttttttgagttacttacagcttttaacaattgattagagcaaaatttgaaacacttttctttctttctacttgatttttccagaatttgaaagctatttgtgagtattcttaacttatggtaatatagttatttgcataaattcagtaagatctattttcttttgtaacaggacacagttggaggcactggctcttttaccaaggctttaattggaagggtatattttcagatatgagcagatttctgtgaggaattgagattgacttatagatctgataaaagttctttggaaaaactgacctcaaacattttctatgtagttcctttacagatttccttacatgttcctgacttgtggtaagtaaagaatgtcactttctcacaggcccaggaaccccaagttattttgggatttcaagaagagagaagtttcccaattcatacaggtatctgcagggataaatacttggctgtgttcatgacttttaaaaggtctaatttgtgattctttatgaaaaaagattccagaaaagccaacttacaacagtctgtatgacaaataattattctgcctgcactttatgcaaataatcaggccaagtataataagactaaactaattttgctaagaaattgatcctactatgattttgtctttagtaatattggaagattggggacagaaaaattatgtttcaaaggaaactatggtataactgttattggattttaaccttatccattgcattcagttttgattattttctaccatttggactggatcctaattttttttttttgaagttgccaagctaaaatgttcaatttctgccctccaattttttttaacttgaaatcactagaaattaaaactctgcttttcttaaagctctgcaaactgaagctatacaacttaaactccaggagaaaataacagcaacttatatataaacaagcttcaagcctgcttgctaatgtaaagacttctcagaaagttagcctgaatgcccggtttgaattacaatccagaagaatttgtcagattgtcgttgcaatctgaagatgcctcagagaccttaggaaagcagtctatagactgctccaaccattaaccttgtttattcttctgcttttatagaaataccttttttagagatcctattgcctatatcatatatagaggtctagcccatctgcaatgccacctctcagaatgggacacagttgtttaatggaactcatctattctcagtattcagagactgactaaagaagatatgggaagatatatttaaatttgctcctttctatttatctcagtttgtctttctactcctttctctatctctgtctaacaatctctagatcaaatctctccaaagctatcagcttggtttttgatatgaaacttattttaaattgcaaataggagactgaaggaaattaaaatattttacccccaaatatatttatttgatgtattttgaaatggctgcctcttggccatcctattagaggtggcattgcaaaactatcttaagtggggaaaatttgcatctgcagagaatctcccttaatgcagccatgcctccctccccttcctattcctttccctgggtccaggagagactgacagtctgacatcttttaaagtctgaaaggaaacatttaccatctgtttcctctgaagggggcttcctccacataacaaggccatctttgctagccaaacttcttcttttctctcttaacacctcttgccactgaagctgatttagctgtttctggcaatcctctgagtgtgctttctttacagtggcctcaggatggtatgtaagtgtctgtaactcattgggatgttgggtcttcattctgaaggctcccttctatatattgttaaataaatttgtatgccctttctttcattaatcaatctgcctcctgtcagtgattttttagcagtcatttagggggccaagaacatttggccctcatgcctttttaatttatttcctttcatttttcagaatgaactgctttccttagttcctggaacatctgtggtactccataaatatttctaggacaagtaagcacttcaattattttacactgtttgtggcatttgggttacatagtgatatggtttggatttgtccccacccacatctcatcttgagttgtaattcacacagttcacacatgtcataggaggaacccagtgggaggtgttcgaattatgggtgcgggtctttcttgcactgtttttgtgatagtgaatgagtttcatgagatctgatggttttaaaacacaagtttctctgcacaagctctctgttgccacccatgtgagatgtgacttgctcctccttgccttccaccatgattgtgaggcctccccagctacatgaaactgtgagtccagttaaacctctttcttttgtaaattgcccagccttgggtatgtcttcatcagcagtatgaaagcagaataatataataaattagtactagaagtggggtgctgctgaaaagatatccaaaaatgtggaagcaactttggaattgggtaacaagaagaggttggaacattgtggagggctcagaagaagaaagggaaatgtgggaaagtttgtaactctctagagacttgttgaatggctttggctaaaatgctgataatgatattggcaatgaaatccaggctgaggtggtctcagatgaggaagttgggaactggagcaaaggtgactcttgttatgttttagcaaagagactggcagcattttctcctgccctagggatttgtgaaactttgaacttgagagagaggatttagggtatctagtggaagaaacttctaaccagaaaaacattcaagatgtgacttgggtgctgttaaaggcattccgttttataagagaagcagagcaaaaaagttcagaaatttgcagcctgacaatgtgattgaaaagaaaatcccattttatgaggagaaattcaagctagctgcagaaatttgcataagtaatgaggagctgaatgttaattaccaaaagaatgggggaaatgtctccagggcatatcagagaccttcatggtaacccatcctatcacaggcccagagacctaggaggaaaatgtggttttgtgggttgggcccaagccccccatgctgtgtgcagcctagggacctggtgccctgtggcctagccactccagccatggctgaaaggggccaatgtagagtttgggccatggcttcagagggtgaaagcctcaagccttggcagcttccatgtggtgttgagcctgccagtgcacagaagtcaagaattggagtttgggaacctttgcttagatttcagaggatgtctggaaacacctcgatgtccaggcagaagtttgctacaggggcaagactctcatggagagcctctgctagggctgtgtgtaattttgatctgcctcagctatggggagactcaccaccagggagattaccaccatcatagctaccattagattactcatggtcagcagcttgttctgagacctcagtttctcttctgcaatgtgagctagtctcttcatctgcccccaggtcagtggagttgcttggtgagttttactggtttccatctgctcaacagagatgtttatctgagccatcagatgaactgggggtgcagggacattctgaggtcttttcctcttccttggattctggctcatggaacagcttaagatgtcttgtggtacccagacaggaagctgattctctcctggtgaggtacaagcaaaccctcgaccccatgtaatgattttgcccttttcccaggttttagttctgacgtccttccaccactcatgttttccttcatgaggatttattttttgccctgtcaaatgctgctctgctgccattataacctgatctctagacaaatccaaaaaatttaaagtgataatgtgtctggaattggtgggttcttggtcttgctgacttcaagaatgaagccgcagaccctcacggtgagtgttacagttcttaaagatggtgtgtctggagttttttccttctgatgtttggaggtgtctggagtttcttcttactggtgggtttgtgttctcggtgacttcaggagtgaagctgcagacctatgcggtgagtgttatagctcttaaagtctgcacgtctggagttgttcattccttccagtgggttcggggactcactggcctcaggagtgaagctgcagaccttcgcagtgagtgttacagttcataaaggtggcatgtccggagttgttcgttcctcccaaccagagttgttcatccctcccagtgggttcgtggtctcactggcttcaggaatgaagctgcagacctttacagtgagtgttacagctcataaaggcagcacagacccaaagagttagcagcagcaagattgaatatgaagagcaaaacaacaaagcttccacagcatggaacgggacccgagtgggttgccgctgctggctggggcagcctgctgttattcccttatctgacctcagccacatcctgctgattggtccattttacagagagctgattggtccactttacagagagctgattggtctgttttgacagggtgctgattgctgcctttacaaacctttagctaggcacagagtgctgattggtgcattaacaatcccttagctagacagaaaagttcgccaagtccccactagattagctagacatagagtgttgattggggtgtttacaaacctttagctagacacagagtgctggttggtgcatttacaatcctttagctagacagaaaagttctctgagtcctcacccgtccgagaagcccagccagcttcacctctcagtggcactcgccatgggatttagcggcacctagcctgggcactctggcagcccagagggagctcatccccagatcaagcccagcaggcgccagctggctgtgctgagtgtggggcctgccgagcccatgcccacctggaacccacaccagcctgtgaacgcggcacacagctctggctcctgcccatgcctttccctccacacctccccgcgagcagacagagctggctctggccttggcctgccccagagaggggccctcatggtgcagcagcaggctgaagggctccttgagtgtggccacagtggactccaaggccaaggagatgatgagagcaagcgagggctgctagcacattgtcacctctcaataagagccagttgtatctgtgtatgtggagtagagtattctctggatccccccttctgtcttttgttttcgtaattgagattttaaggtttagttagcccattcaacaatggcttggccttgagaatcatagggtattccagtactgtgctcagtgtgccattgttggaggaacacttgtaaagatttactacagtagcctgggccattgtctattttaatcttttgtgggatgcctatggcagcgaaacaggaaagtaaatgtttcttaatatgagctgctgcctcacctgtttggcaagttgtccatacaacacgagaaaaggtatctatagtaacatggacgtatggaagtttcccgaatgaaggtacgtgggttacgtccatttgccacaacatattgggggttaatccctgtgggttagcaccagtccctgcatgtggcagttgtagtacctggcactgagggcaatgttgcacaatgtcctttgcctgtctccaagtaatttgatatttttgtttaagtcctgctgcattaacatgtgttagggagtgaaaatcttggacattagtaagcacagtggaaactagtaaatcaccttgatcgttagcccttacaacggtcccagggagattagtatatgctcgaatgtgcatgatatagaaaggaaaatagtgatcacgcactgccttttgtaaagaagaaaacagctgatagagttgttcatccacaagatatttaatgagtgcagtttctatgtattgagtggcttgaacaacataagctgaatcagagacaatatttacaggttgcttaaagtcttctaacacagctataactgcctgtaattcagccctctgtgccgattgaaagtcagtttgaataattctgtttttaggtcccacataagctgcttttccatggctagagccatctgtaaacacagtcactgctccttccaatggagcacaatgggtaatttttggaaggacccatgttgttagctttaaaaactgaaaaaaattttttttggatagtgattgtcaagaactccaatgaagccagctaaatttatttgccaattgaccaaattaacaaaggcttgccgatctgatttgtattcattggaactataatgttatctggatctgaaccgcgaagtttaacaactctaaggtgagcttgtccaatcaagattgccatctgatccaagtatactgtgagtgttctgacagtattctgaggcaggacggaccattcaagtaagtcctcactctgaactataacccctgtaggagaatggagagtagggaacacaatgagctgtaatgataaacttgagtctattctattatcctgggactgctgtattttttcttcaatcatttgtaattctttggcagcctcaggagtcagttctcatttactattgaaagcagggtctactcttaaaatagagaacagattagacatagcataggtagggattcccaaagtaggtcgaatccaattgatatcccctaataatttttgaaaatctaagttttcagagagtctttttgaatttgaaccttttggggtttaattgccttttcctgaacatgcattccacatattggaaaggagtggccgtttgaattttatctggtgccatgagcaatccagcattggctaccacctcctgtaaatatgagtaacactggataagttggtcttgatttttggccacacacgatatgtcatccatataatgaatgatatacgaatctggaaactgatctctcacaggttgaatagccttccccacagaagtttgacaaacagtaggactattcaacataccctgtggcaggactttccagtgatatctggctgctggttccttgttgttcatagcaggaatagtaaaagcaaatttctcaaaatcagactctactagaggaatattaaaaaagcaatccttcaaatctataattattaatggccagtctctaggaatcatggtaggggatggaagccctggctgcagggcccccattggctggatgactgcattgaccacttgtaagttggttagcatgtgccatctgccagactttttctttattacaaacactggtgaattccatggagaaaatatgggctcaatgtttcctttgtttaattgctctttgactaattcctgtaaggcccccaatttttcctgagaaaatggccactgctagacccaaacaggatttcaggtcttccattttaagggaataggacttggaggctcaacagtgaccacccctaaaaatggcaacctaatccttttcggtcattttttacagtaacctgtatgggttcaataatgcctgcctcctgttttcctaggccttttctgggaacatagcccatgtttgacattattttttgactagcttgaccatacctgggagaagagattgaaatttctgtgccccattgtggaagcagatctctcccctgtaagttaacaggaatgggtgtaattacaggttttattgtgacttcctgttcttctggaccaagaccaataagataaaagtactttggaaaacttctgaagcagttctgaccccaacaagacccactggggccttttgtttgggccagttttttggccattgataaagagctatgattgacacatctgctcctgtgtcgaccagaccctcaagttattttccttgaataatgaccttacaaatagatcttttgtcagagacttgatttacccaacaggcagcctcccctgctgaatttgtgcttccaaatcctcctgttcttttttctgatttgtcttctaacttaacatacgatcaaagcaacagttgagctattctgtcacctggattagcactccagggaacagtggaagagataacaatttgaatttctccctggaaatcagggtccactactccagtatgtacttgaattcctttaagtttaagctggacctttccagtataagtcccactgtgccttttggcaatgggctgtaaactcccattgggaccttcctaggaggctccccaggaaggagggatacagctttggtacagcataaatctactgccccacttttagctgtgaagggggatgattgctttacatttgtaacagggatagactgggctgggaacactccatttggagtcggggacatcatgtcctgaattgagaatgccccattttgaattggggcccggggctggcccctctgtccatttcccggcaagggctgtccactattatcaaactttgagtgacattgattagcccagtgttttccttttttacatctaggaaaggtacctggttccctgctttttcctcctgagttttgccttttttggctctttgtacactctctttttgtatgtcctatctgtccacaattaaagcaagatccagggaacactcatgtgttttttgttacccttagtccagccattgcctgagcaaggagactggccttatataagcgccccccaatgccatcgcaggctttaatgtattcacttaaagttttttcctcatttagatctgcctttcccttaataggtctaatagctgcctgacattctgtattagcattttcataagcaagcagctgaacaatcactttcctggcatgagaatccaaaatagccttttgagccacgtcttgcaaatgggcaataaaatctggataaggctcccttggaccctcttgaactgagttaaaagaaggataagtagtatgagggttgtgaattttttcccaggctcttaggcatatagttctgagctgatcaacagcctcatcacccattaccatctgttgatttagagtactccatgcctgtctgattccaagcaattgatcagatgtgatattaacgggaggttgggcttgagcactcctgcatgcctgatttgttgcttcatccatccactaggttttaaattggagaaattcagagggggacagtgtggatcgggctaatgactcccaatccataggtattaaacgccggttataagccacagaatgtaacaaggaatgaacacaaggagaatttggcccatattgtccaattgcttgttttaagtcttttaatattttaaaaggaaatggctcccagcatgcttgagcatgttctctgggctccttagctggcgaaatgattactggaaaccgccaagcatccaaatcccccatttcttgtgcctggtgaatggatgcctgattgtccctgcaccataatttgtatttgggccggcttgcagcattcctctatcataattaacaggtgggcaagcctggatcattccctcactttaattggctgttgggcgagctgaagcttcccttcaccatagttaatggtgggggttgcaacaatgggagtggtgagtcgcgtctcaggctcccattccaaaaattcgtaaggctgaggcgggggtggccattctggaccttcccctaaaggtgcagtaggtggcactatttctgcagtaggtggaactctttctgtcctaagtttttggaggttagcatatataccttcccgtttctcctccttttttaaactagactgtgatggttcactttgctgagcatcagactcctgattattaaacttttctatgtcatcctgaaactcatcctcctcctcctcagtgtggaagggctccagtgctattttaattgctgaccacacagaccaagtggagaagggaatatcgtggcccttttgttgtgctcgttttaagtctgatctgaccttgtcccaatcttttacattcatggttccatattccaggaaccaagaagaatacttttctacgagatggaacaaagatgtgagattttgggtactcacaattacccctccatggtgcaataactgccacactagacttaagtaattagcaagcttactttcagcctgacccatactttcctgaggtaaccctggaattctcccagtgccctacttacctgtagaacctgaagtgaaaacatactcgggtgtcctttgtcggtcgtcctccactttccacattttggtgtttcttcaccggattatttgtagagattacagggagccccgtgttgggtgccagatgttggggaaaccagccccacaccacccagtgggtattctgagtccagcgtagacaaaggagttagaaagagacagaataagcactttaaaggcgggtccaagggaccggggctttggaggcttgctcatggcccagagctcttgggctctgcacaatttattggtttacaagcaattcgttcttagggcagatggcagggggaggaaggatgaggaaaaggattaatcagtgaaggagaactcgtgagtcattcaataagatgtatagcagtggcagtttctgtgaatttcattgagcaaaggcatgtgtctaaactacttaagatctttaacttatcgggactgaaacaggtgggagtggggttcaggaggagccaagatgtttgattatactccactgcttcaagggagtgttatctccctgagcaacctgcagaatgctgctgagtggttatgctctcggggcataaagacatgaaggcaataaggagacttttctcctcagaggccacccatggctccccatgggtgtctcacacaggtgagaccaactcaattgacacccagaaactttctttcccacagtattttatttactgagttgatgatttaggcctcaggcaaataggggaagcatccctcttttggcaccagttgtagctaaaacaggtgtgtagatataatacccaatggtgggtagaggtcccagccttgatgaaggtggtggctggtgtaggggggtctcaattagatgtgctgaagttttatcaggttgaagggtgggagctaccttatctttcctgtgaagccagcagaaaagctatccacagccacactcctgtcctaatgttctggttactcagatcagacaggcatctctttttatctgtagaaatgttgatgttccaagtagaaaagaattatgactctgcctcttgtgcagtcctgaacctggagagtgcttctcctgtggggctgcaatcaacccgaattgtttcaagaaggctgtctgtatgtgcatctatgctgcatgcctatgagagaagccctagccatttccgcagtagtgtgcctgggagaacaaggacccctttttcaagaccctttatgatcacagaggctgcctgcctgatggggtagaggtgcagactttctctactgtgtccagcactgcaattgtgtctctgttgtaagaaactttccactagtggaacaatctgggactcaagtcctgatattcagagtctcttgtcccacagggtgttcccttgatgtggtgctctcccccttcccttaggaatgggatttcctgggagccagactacaatgattgttactgctcttctcggtctagcaacccaatggggctaccagattctctgctggtgctgggtaatatctgcaaaagatccagtcatatgacctgtcttcaaatgtcccagcagtggataccagcacctgctctgacaaaggtggaaggggagtgatgtaggctctgtgagattccttggtttgagacaaacttattgggctggcttccttaaatgctgcttatactggtagtgaactcatgacatggacagactcaggatctctggttagccagggtgttgcaggcagtggcgatagctgagatcatgcagccattttctccttcctgggtgcagtgctagaggtactgtaatggcctgagttggttggcctctagccaggaggtggtgcttgcaagacagcaccagctgcagtagtagcagtgggatttgagctttccgtaagttgcccaggggaagtaatctgttttttcaggtgattggtggggccataaagctcccaaaagtttatatcctttgtgttaagctaccagggctggtggagacataccaccaggtgggggtagggttacatgggtctaagttcagactcctgggtggggcaggccatagcccctatggggagagtcattctcaggccactggggcaatgttccagaggggagagtaaaactgcctctcccctctgtgcctctgcacctctgctgcacagaagagttcacaaagggagtggggagtcatgggcagcagtaagcttcacccagctcccatgcagttggagaggctggtcttgctcctgcagtgctccactaacagcgctgggtttagatcccggtctgtgcacagaactcagacctgccccaggccataagcttcccacagagatagaaaccacagctttgaggccatgcttctccatgtctgctggcaaggctgggagcccagctctgctcgtgtctgtggctcacttcccactcaccgtcccactccaggttctgttcaagggaattcatccccacttgagattatgtcacaaaattcagtttggagcttctttcaccctgcaactcttccctaagcatgttgcctgacttccccgaggacccctgtgagatttagtaagtaatgtcttccctaggctcatgctggagactgggaatgcctacaagtacttcctgatgatgcttctacttgtatattgcatgctgctccccaattccattccagctttggatagggttatggccttctcctgtggtctggatttgcagattccttggtcaggatgagtgcttggaggcagactctctccccttctagcaatctgggaatttagttttttgccagtctcatggactagactacagcctgccacttctttcctggtaagtttctgtggtggctcttgaaaaaagaaattcacagtgttactctctactgactattctgtccttgcaagtgggagaggcacaataactctgcctcctatccaccatcttgaaaaaaagacaagggagtctatagcagatatatgggtacttagggactgcatggcctgggttacattgtgagagtaatcagggatatatacataacatttagttttaattaacacacaagttatgccttggatggcagttaagatgaccagggccatacagttttgcaaagtaaggcatccaatttgggtagtttctttagtgagaagagtaatagcatggcaggtatcattgaaggctgcagccatagatttagccagggcctcaacttgtagctctatatctattgtcactgcttgacagcccacaaacactcaggtaaggagaggccagcctcagggatgggtggtttgtgagggatgccattttacttatctcaagtctggagagtataataccctctgtcttcatgttccatagacagagaagccatcccttgatcaactgtctccccttctatctgaaccaatttcccagctctgccaattctttagtggtataatcctgcattggggttcactgcagtctttcaggtgggggcaagtcttgtggagctactccctgtatgcacagttggtctgcttttatcttggtggtgacaactggacatgaagagaggaaaggaacctctataggcttgtcccagtcctcactgtccttctcacagtttctctctatggggttccaggacttagggtcccagaattatttagtcataatagccctgacttgttgatgtggcagctggcgaccctctgaatgacccacctgacaagccagggtttaccttttgtcatcctgcgcccaaaggtctccaatgttttagcctgagctaagctggtatctctttctaatctcatccattttataagtgagtcacccttgcctgtaccacaaactcagtctctggctgcttggagcacagtcaggagaggctagccaagtgtggctgtgatggcttgggcatctgactttcgcttagttggattaaccccctgcaacagcttgtccagatcctttggcattgttggagtgtcctcatactcaggcagtgggacccatccatctattgggccccacatagatgtagatggccagcctgagattccccctgaggatctccccttcctgatcctatccttttggcactcatgggatattctctgacctcctggctgggcttggcaattgttggactggacccctattgactccaacagggatggcactgtgtctgagaggccaaagaagacacctggagacagtgaacgagacatagggtttattatgggtaacttacatacaggggcagttcagtggaggtaggctggacaggagaactgctgctgttcataaatgcagcagtttatatagcattttcacttagcaccctctacctagcaacctacatctaactcaaaacaaagggctccgatcccctgttcgtcctgtattccaagggatggggccgagatttcatagagaaggagtgaacctctgggttggccactcccagattccttagctcagaactctgaacacacattctttgtatggtcattgtcagggtgtgcttaagttattgctgtcaggtgcatctgccatacacacactaactataatatttatttttagcctggttgtgccgctaatattgctatgtttctttaggtgatgtaaattaacttaattcctctttggaaaattagggagctttacttgagacgaaatattaaatattttttggaaatgagtttaaaaataaatgctcaaaaatcataaaagctattaaaatgatgtttgatatacactgatttagagggtaagaaatcaagtggaattaattagttgctcaactctaaaagactcactaataaagaggtaatgaaatgttcatggtgaaatgtttcttttacaccaattttttatgctgagataggttcagctgggatgcatgcacagctgagaggcagtgaggcatatgggaagcatgtgagttttggaagacagtcctggatttaaatctgcaatttagagatgtgtctgggtaaatcactcacagcctccaaatttcggtttcctcatagaatttctgcataataatccctgaatggcaggactgctgtcagcatttgaggtgatatttgccgtttctttggtccaaaatttagtacatacaagggactcaataacgattagatattgttattagttgtccagaaagcaatctgcttgcaccaggccttttgctcctggaacatcccatgtttttaacttcgctgatactttgttttgctctagagggagtggaaactagcttaaggaggtgaaaacatatctcgttatgaaatggcaattcattttcctaaaactatacagggaattcagtttccccatatctaaaaagagtgggtgggctatgaaatatctaaaaagagtgggtgggctatgaaatatctaaaaagagtgggtggtctatgaaatggaatgggttaaagacttctctgaaggccttaatttctaatatagcggtttgtatctgctgtgtacgcagatgagagttgtacctaaccgaggagcgggcggtccttgcagcgtgggctccaggaaaggaaaggaagccttgacgcagcatcatttatggacttgaacactaggtgtcgctcgcgcacttgttttcagccgtaggattcagagacggtattttaggcttagacccaacacttgatttacagttcttccgaatctttgccccacacttatacattgttttcggatgtttgtgccaatctcctgctaacctatgctctctgcctgaacctcattcacctgcctcaaatttctggcttattgaagaacagaactccttaattccatttcactgctttctaggtctcaacatttttgctcttcttttctgagaagtgttcggcagtataccatatctacactcccatccataggcctcttagtgcaccagatccaaaatatcttatataaaggatgatataaatatcttacataaaatataaatgtataatgtctataaaatatctttcagtatcttttaatatctaaagtaccttgtgtaacgatcttatacaaagtatgacatcttatataaagtattatataaagtcattgattcactgaacaaacattatttagttttgtgtgcagcatagaatcatcttatgttttgatgtaaacactcaagtatttgttcctgatgtattcagaagaatatttagggaatatgaaaattccctaacacatataaaggatatcgtttatccactggagtgtatagataggataatttttctaaaaatataagatctctctcttagaaaaggataaatacattctgtgttgcttctaatgtttgtcaggggaaggaggccacattgagttctattgtgagaaaagaagcagaatgagaatgaggtcttttgcatggaagggataatgagagtttgggcagagcaggaagagactactaaagaggggacgaagtcagcaaaaggatggacttggctagggagagcctgtattcatgcccctgagaggtctgagcgtggttgatgacctggaatgggtgtattctttgtgtccaaacctgtggctcagggatgacctagctgggccagctgtcctcattaaatagtcattatttttattaaatggaggatcgtgcttcattcaaagtcaataacagctagtatcaatgactaagatattgactgcctagtagtagcaacatccctgcctacacccagagatattatcagccaattacctcatcatctggttatgggggaatctgtgttctgcgccatgccttgagcatgacacatattttggcaaacctatgtctaggtttcctttctgcaataccatatgaaatagtaaactcgagtgaccactggacttctaatgggatgagcagtgtggcagaagtttctgttttgctaggaccatcctaacctaagaaagtcatgaagtaaactccacagtatcgtgtatgaaattctatgctaggcattgtagactaaatagagatgaataagacttgattccttatgtctgattcctgtttatggggcagaatggatactatgggtccatgataaagtgtcaggtcaggaggggaatacattggggtaagtatttccctacttgagacagtaaatgcaaataaggttttgtaagtccctttactcttaaggtagggctcaactctgttttaatacatttctgacttctgagttcattggtttatgtgtgaaacaaaaagattactttcttaatttcttgaaaaagtccaatatcatctgtaaagtcttttgttgatgttatatgatatcacacagaggaagaattatgggttggatcgtaatactattagcttgatgagtttctggctgaacattgaaccacacattgctaatctgatatgttttctgctggtaaatatcagagccttgttgtggcccgtattctgttcaatacgttcatcagggatttggataaagatatgaaggacacactcaccaaacatgtggatgacacagagttaagagggttcatgaaaaaaaaccctaaatgacagaatcagatgaaagcggtcctaacatgatagaaagatgaaccaaactctaaaagaagtgtgatagagataaacattaagcactatatatataatatatatatatatatatatataactttagtattgttaaccaaaataaactaggttcctgcactaggcctgacagaccaaaccaacataaagttgaactccaggagctgagctttagttactgcaggacgctccgtagccagttaaccaatgaagctgtatccaattcagttttctgtacaccgtacttctgtttcctataaatgctgtcagatcatgttattagttggagttctctgaacctgccctggttcagaggactgcctgatttgtgaatcattttcattctgtttttactttgctttgctttcctctgctcaaataaagtcagttaaatttaaatttggtctaaggtttttctgtttaacagcattgttgaatcttaacattagaagtatgacaaaacaaaaacaagcaaaaacgtaacagaatataatagttcaaaacacaatatttggtattacagtgagacatggttaaataggtaaggcataaatctctctctgtgagttctagatcagcttatcaagatcattaaaatagcaacagcctgaatcctgaactttcattttgtctctttggaaactgtatttttgacattgacaggcttaaggcagccttatttattctgaaaataactagacagagaagtcttcatgagcaagaatatcttaaactttcatgattccagctaagaatagcctgtctacagtgtgacatattggctacatttgtcagcctttttattcatgaggatagtcacacacttttaagatcaccaaacaaaaccaccctatccatccattgactttctttctccctttatcactcaaagtgaattcagcattgaatttgtttacctgcattaggtaacagttttggaaccggttgcatgaggggaagtaatgatacagttctttcattctataatatttttcgtgaatccactgcagtgtttagggttatccataggaatgtttaaaagaggttttctgcagccgggtgcagtgactcatgcctgtaatcccagcactttggaaggccgaggcaggtggatcacctgaggtcgggagttcaagagcagcctggtcaacatggtgaaaccctgtctctactaaaaatacaaaaaaattagccgggcgtggtggcgagcacctgtaatcccagctacttgggaggctgagacagagaatcacttgaacctgggaggtgaaagttgcagtgaaccgagatttcaccaatgcactccagcctggatgacagagtgagactctgtctcaaaacaaaacaaaacaaaacaaaacaaaaactgtatccaagagtaattttttacttgatttgatacttgagagattctcatgtatctgagaagcacctccatcgtaaatatgtgatccaccccaacaactgaaagcatattggttacaatttttgcagaattagagcacagctcatgttccttctatctcgttaggcatatgggaacatcactctggatgatgatgtaatttcacaagtgttgaccattgaggtcgctgagttatccttaatttcttgtcagcccttctgtgtgatataggcagtgttgcctcttacatgctcaccagtctctactctgttgtcctgattgttgaactttggtggtgatcacctcactcagatccacacccacctgttcacctgtttctgagagtggtcctgagcatttccaggttgggcatggtagaggttcagtgggactggtggagattgaggtggcagtaatgggatccattattttaaggataaaacttataaattacaactaacaagacaaaaaaccccatctaatctttaagaacaagatgctacagatttagcagtaatgtttgtgaaaatgtcttaggggctataaagaagaatattctcaaatgaatcaactgtaatgtagcagcagaaacatcaatatgttaaacaatattagtggaagtgaatttgagtgagtgagtgggtgtaatcctcctcttgtgagttgatcaggccacacctgggaactgctttcaggttttagcaatatgcttttctttcaaaaataacattgattatttttattacaaagtaatatattatcactgtagaaaatctagaaagcacagaaaaatacatcaattaaaaataatctataaccccgctgatcggatagaatcattaacattttgttatgtcttctttcagatatatgcacacacacataaatacatatgtacatatgatcacattttgttttgtcatcttttatccccacttgacaacatatctcagtttctcagttaagtgacattctgttgtctattcaaacacttttaaaatttatcatataggtatactacactattattcttaaatattagaagtaatgctatgatgcacattattacagataaacatttgcttatattcctgaacatttccctaaagaaaattcttagatgtgtaaattctggataacaagagtattggcattactctttaagagagacatggacaaaccaaggtatgttcagaatagtgactttatttatggactggaaacaatatcatttgaggatagttgcaagagaaaaaaatggagattcaaaacttttcacatatttcagtgcttgtcattgaaaagaagaattatataagtcaaaaatacattgtttagtaccagtagcttgaagctacaggagacagatggtacagtaccatgtgaaatgcttgttactgtcagagctattaaaagtgaattagggcgagggtgactcaaggggaagagagtggcctgaacttggaggtactgagtataggccaatagccatttaaatgtggccaaggggattcagaggctaagcgtggatcttactaaggctaaggacttttttattattattatttttattttttgtattatactttaagttccagggtacatgtgcacaacgtgcaggtttgttacatatgtatacatctgccatgttggtgtgctgcacccattaactcatcatttacattaggtatatctcccaatgctagccctccccctccccccaccccacgacaggcccagtgggtgatgttccccaccctgtgtccaagtgttctcattgttcaattcccacctatgagtgagaacatgcggtgtttggttttctgtgcttgcgatagtttgctcagaatggtggttccagcctcatccatgtccctacaaaggacatgaactcatccggctaaagactcttctaacgctctgagtcaataatttgtcctaagtggaaaatcttaagaaatgaatacctgatgagttttgtttttatgttttatttccataggtgtttttgggaacaggtagtgtttggttacatgaataagttcttttgtggtgatttctgagattttggtgcccccatcacccgagcagtatacactgtacctaatttgtagtcttttattcctcatctccacccagcattccccccgcagtctccaaagtccattgtgtcattcttatgtctttgcatcctcacagcttagctcctacttatgagtgacaacttatgatgtttggttttccatccctgagttacttcacttaaagcaatggtctccaattccttccaggttgctgcaaatgccattatttcattcctttttatggttgagtagtatccatggctggttagattgttttgttgtttggttgttttttcatgttggtagagggtagtttacacagggttttggaaaatataaaataaaaccaacagctacaaggtggcttatttgagaattcaggtatattttcttgctaaaataattcttaaagttcacacttactcatggattttttttttttgaggcagaatttcgcttttgtcacccaggctggagtgcaatggcatgatctcggctcactgcaacctctgcctcctgggttcaagcgattctcctgcctcagcctcccaagtagctgggattacaggcatccgccaccatgcccaggtaatttttgtattttttttttttttagtagagactgggtttcaccatgttggccaggctggtcttgaactcctgacctgaggtgatccacccacctaagcctcccaaagtgctgggattacaggcgtgagccactgcacctgcctggattgttttgataatgaaatagataataatttccattgttatagtgcttattatcacctggatattttaaaatattaatcagttttttattgtttataatccactcacatatgtaataggatggatgcccagctaaaggtcctatgaggtgttttcctccccttcattctagggagagaactatcagaacttgttgtcctttgtggatatgaaggcagtttcctgacaaagggtcttcctggatgcagctggagctgagagtagcatttgacacagagtaggtgtgtgtgaatggatgaatggatggatgaatgaacagtgtaatgccctctggagggtgaagagaatacttccattatgtaagaagagagatgtaatcagactctgtgtttcccagatggaaaggaatacctgcttgatctttgaggaagttgattccttagaaggaaaaagtgacagtggcttagggtctacaaagggaggaaactaagcacactgctcctgggcttgccccttcggacaggctaaggatgggtgactaagggagatagaaaggcctgttctgtcttggtctaattcagaaagagttgggttatcctctctttaaggtctacttggttcctctgtgggaacagaatgaataccagccccgatgaccagcaccaaaaccagcatcagaatcagcatcatctcttgaaaggggactaggggtattagctcccatgtgccagcaagaagcagtggcattagtaacactgttagaagagtaaagtttctttttgcttggatatagaagttggactgcattctcatatttgggctgagaaagctattacgttcttgggtaatgtaaggataagtttgcctctaaagaaagatctaggagaatgtaagctaactggaagtagaaattcctgctcattttgtttattgatgtgtcccgcgcatagaacaatgaccgacacatagtagtgactcaatgaatatttattgtataaatgaatactgtattttctgctaatgtggcaaatagtgcttaaactattaatcaggaaagtaaaaatgtgatgacatgttctgatttgtggagcatttatatcatctcttaattatatatttgcacataaataagaagatgggaatatatggaaaaagactacatttttattctgaaatcagaactctttttaactcacctcaatactacaacctacctaaacataattttgttaatgtcatcactgttaccggtgagtagattataatacttatctttcaaatcaaatttttgtctgtgttgtgaaagccacaattagatggagcaaggatcaataaagtatccagttaatacaccagaatataaatgaaatgaatcataggaaatgaaatgacttttgacaaatgctgagacaaatgctgtggcacaaaaccacaggttgtcatttgaaattgatattgtagggaaactgtagttgcagcatgaactctaatatataaatcttccatggcacaggtgttcactaatttgatttctaaaaatgctaggcattatgaaatgaaacatatttctgagcatttctgactcatttacagattcagatatatttctttcttttttttccctatagctcatataaagagactaagaaggatgtttattttagagtttcgaattttcatttttatttaaaagactagccataactaggcattaaaacttgttttttgctatctctttccttttttgtagaaaggcttcaagataggatttgaaaatgtcaacaacaaaataagactattcaacctgaagccttttggcagaataaatacatatttgtgctatatttgatacaaatacataaaagagtttgggtggacagcagccattaggcaaattaaagcttcactctccaaagtgtgcataggtcgtattgtgcaccaatggacggcagttcctgagaagtataagaataaatggaaatgttaagatcagaatttatataacaagaaattttataaggcaggtgagaaaatacatatggatattatagtttttttagctttattgacatataattgtctaataaaaattgtacatattaaaggggtaaaatgtaatgtttgatgtacataaacaatgtgaagtgcttaccacactcaagctaattaatatattcaccacctcatatagttaccatttgtgtgtgtgtgtgtgtgtgtgtgtgtgtgtgtgtgtgtggtgaggacacataaaatatactctcttagaaaatttcaagaatatttttattattaactatagttcctcatgctacaccataggtctccagaaattattcatctcatggctgcaaggttgtaacctttaacatcttcggatccctgcggccccacccaccactgtcactaacccctggtaacctcccttctactctctgtttctaggagtttgacattttgggattccgcatgtaaatgagatcattcagtattttgtctttctgtgtctggcttatttcacttagcataatgtcctccattttaccatgttgccacaaatggcaggatttccttatttttaaaggccaagtaatactccattatatctatctatccatccatccatccatccatccatcatctttctctctctctctctctctatcacctatcacattttctttatccattcatctgttgatgaacacttaagttgttttcctatcttggctcttgtgaataattctgtaatgagcatgggagtgccagtatctcttggagatagtgatttatttcctcagaatagtatagtgagaagtgggatttctgtattatatggtaaatctatttttaattttcttgaggaagctccatactgttttccataatagccataccaatttacattcccaccaacaatatataagttccctttttgtgacatcctcactaatacttggtgtctttttgactttttgataatagccatcctgacagacgtgaggtgatacctcactgtggttttgatttgcattccccagatgactagtgatgttgagcactttttcatatacctgttggtcatttgtgtcttcttttgaaaaatgtttcttcgggtcctttgcccatctttaaaatttggtaatttagttttttcttgttgagttgtagtagtttcctatgtgttttggaatattaactctactggatacgtggtttgcaaatactttctcccattatatgggtcatcttttcattttgttgattatttcctttgtcatgcagaaacttttagcttgatgtagtaccacttgtgaaaggaaaataaatcttggggcccccaaatctctaagctaaagggaaaagtcaagctgggaactacttagggcaaaactgcctcccattctattcaaagtcgcccctcgctcactgagataaatgcatatctgattgcctcctttggaaaggctaatcagaaactccaaataatgcaatcatttgtctcttgtctacctataatctggaagcccctcctcgcttttagttgtcccaccttttcagaccgaaccaatgtttatcttacatatgttgattgatgtctcctgtctccctaaaatgtataaaactaaactgtggtttgggcacaagttgtcaggacatcctgaggctgtgtgatgggcgcacatcctcaatcttggcaaaataaactttctaaattaacagagacctgtctcagatattcggggttcacacacttacttgtttttgtttttgttgcctatgtttttggtatcatattaaaaaattcattgccaagatcaatgtcgtgaagcttttcctctgtgttttcttttagtagttttacagtttcaggtcttttgtctaagtatttaatccattttaagttgacttttgtatatggtgaaagataagggtccagtttctttcttttgcatgtgaatatccagtttttccggcaccatttactgaagagactatcttttctccattggatatttgatatctttatcaaagattagttgactgtatatgtgtaagtttatttctgggcattctattctgtttctttggtctatgtgtctgtttttatgccaataccatactgttctaattactatcactttgtaatataatgtaaaattaggaagtgtaatgtctccagctttattcttcttgctcaagattgctttagctattcacagtgttttgtggtttcatgcaaattttaggattgtttttctatttcagtaaaaaatggcattaaaattttgatagtgattgcactgaatctatagatcattttggatagtatggacattctgacaatactgattcctctgattcataaacatggcatatctttccatttacttatgtcttctttaatttctcttatcaatttttatagtttttagggtacagatcttttacttccttggttaaatttattcctgagtattttattatttttggtgctattgtaaaaggaattgttttattaatgtcctttcagatagtttgttattagtgtatagacattaaaaactgatttttgtatgttgattttgtatcatgcaactttaaaaaattggtttattaggtttttttgtgtagcatctttaggattttctacatgtcagatcatgtcagctgcaaacaggggcaattttacctattcctttcaatttgaatgccttttgtatttttttcatgcttacttgctctagcgaggacttccagtactatcttgaatagaagtggtgagagtgggcatgcttgccttattcttgattttagaggaatggttttcagcttttcaccattgagtatgatgttagctgtgggcttgttacatatgacatttattctgttgagtttccttgtatatctaatttattgagagtctttgtcataaagggatattgaattttgttggaagctttttctgcatctattgagatgattacataatttttatcctttattttgctaattacaggcctatattcctagtgaacataaatgctaaattccaaattctgttgaagattttagcattcatattcattagaaatattgtcctataatttttttttgcttgtagtgtccttgtttgtctttggtatgagggcaatgctgacctcataaagtgagtttggaagtcttgaatttttcagtttgagacggaatgatattagttattctttaaatgtttcatggaattcaccagtgaagccatcaagccctaggcttttctttgataatagatttttggttactgattcaatctacttacttgttattaatctatttagatgttctttttcttcatgatttattgttagtaggtagtatatgtctaggaatttatgcatttcttctagattatccaatttattggtgtatagcagtgtcttatcatgcttcgtgttcctattgtatcagttgtaatgtttccttttttatttctgattttatttgtttgagttgtctctttttttttcttagtctagctaatggtttattgattttggttatttttttttgaagaacgaacttagtttttctatcatttattttgtttttctagtctcgatttcatttatttagactctgatctttgttatttccatcctttttactaactttaaccttagttgattcttctttttctagttactttaggtgtaatattaggctgtgtatttcagatcattcttcttattttaatatgggtgtttattactatacatttcctcttagaactccttttgctgaatcccataagttttgctatgttgtcttgccatttgcatttgttttaagatatttttaaatttccctttttatttcttgttggacccattggttgttcaggagcatgttgtttaatttccacattttgtgatttttttagttttctgcccattattgatttctagtttcataccattgtggttgtaaagtacacttgctaagatttcaatcttcttaaaattgctaagaattgttttgtgatctaacgtataatctatgctacagaatgtttcatgtgcactagataagtatgtgtattctcctgctattgggtgaatagaatgttctgtatataactgttagtctatttggtctgtagtgtagtttaatgtcaatgtttccttattgattttatgtctgaatgatctacccattgttaatactgaggtattgaagtctttatttttattatattgctatctatcttttccttcagatcaattaatatttgttttgtatattttggtgctctattattcagtacatatctatttacagccactatattctcttgttgaattgaccccttcatcatatgtaatggacttgtatttttttttctttttacaatttttgacttaaagtctatttttatgtaagtgtagttacccctggtctctttgcatggaaaaccctttttcacctcattcactttcagtctgtgtgttcttaaagctaatgtgaatcttttgtaggcagcatttagttgggtatttaaaaaaaaatccattcagccatgctatgtcttttgatttgagaatttaatccacatacatttaaggtaataagacttactatcatcattttgttaaatgttttcttatttttttggtagatgctttgttcctttctttgtcttttgtggttgttctccttttgtgatttggtggttttcagtagtgatatactttgattccttactctttatcttttgatttctttatctgtatatttttgtgtatctactatatatttttgttttgtgaccatcatgaggcttgcatggaacatcttttagttacataagtctattttagctgataatgttaattgcatacaaaagcatttcacatttactccccccaatttatatttttgatgtcacagtttatatctttttattttgtgtatccattaagttatcgtagctacagttttttaaaaaataattttgccttttaacccttatactggagggttttttttttttgagacagaatctcactgctttattgcccaggctggaatgccatggtgagattatagcacattgcagccctgaacttccaggttcaagcgatgcttccacttcagcctcccaagtagctgggactacaggtgtgcaccatcatgactagctactttttaaaaaatttctggaagagatgaggtctcaccatgttgcccaggctgattttgagctcctgagtgcaagtaatcctcctgccttggcctcccaaagtgctgggaattcaggtatgagccaccatgcctggtccctttatgctgtagttataagtcatttacacactacctttacagtattaaagtatttgaactggactatgtacttcattttaccactgtttttaatacttttatatgttttcatgttactagctagtgactttttatttcagcttgaagaactcccttttgtatttcttgtaaggcagttgtaatggtgaagaagtctcagctttgttttgtctgggtaagtctttatcctttcttcatccctgaaggacagctatgctgagtaaagtgttcttatttaatagttttttttttcttttagcactttgtctatatcattctgctctcctctggtttacaacatttctgcggagaaatctgctaatagctggttagaagttccctggtatatgaggatcttcttttctcttgctgctttcaagattctatcttggtctttgatgtttgacagtttattatcatttgactaccaacgtgtagttttctttgggtagaatttattagaaacttctgaacttactatacatggttgtttattttttcttccagatttggaaagccttcagccattatctctttaaataagcttcctgtcctttctttctctatcctcttcttaaatgtctataatatgaaagttagttctcttgatagtgtcccatcaatcttgtaggctttcttttttcctttccatcttttcttttatcatctgactggatatttttaaataaccagtctttgagctcacagatttttcttcttctttatcaagtaagctgttgatgctctctatttcattttattcattgtatttgtcagctccagattttctgtttttttaaaaataattttaatctccttggttaagcttttagttttgttcatgtattatatttctgatattattgaattgcctttctgtgttctattgcagttcactgagcttatttaaaacaattattttgaattctttgctagatgattcatagatatctatttttgggagttggttactggtgtgaaccccaacaatttgagacaggtctccattaatttagaaagtttattttgccaatactgaggatgtgcatccatgacatagcctcaggaggtcctgacgacttgtgcccaaggtggtcagaacacagtttggttttatacattttagggagatataagacatccatcaacatgtaagatgaacattggttcagtctggaaaggtgggacaactggaagtggggagggggcttccaggtcacaggtagataagagataactggttgcattcttttgggtttctgattagcctctccaaatgaggcaatcagatatgcatttatctcagtgagcagaggggtggctttgaatagaatgggagggcagctttgccctaagcagttcccagcttaacttttccctttagcttagtgatttggggagtccatgatattttactttcacactggaaatttattatgcttttttgatggtgttatgtttcctaatttttcatgtttcttgttctgttgagttgatgtttgcacatttttctggagcagtcagctcttccagaccttacgaactgtttttggtgggaaaaaacccttcacctctgggtgggtaaaggggcgtcagctatgaggggtgcagtggtttcagtttcagtgaaggtacagaggcataatctctttttatttttattatactttaagttctaaggtacatgtgcacaacgtgcaggtttcttacgtatgtatacatttgccatgttggtgtgctgcacccattaactcgtcatttacattaggtatatctcctaatgctatccttctcccctccctctaccccacgacaggccccggtgtgtgatgttccccttcctgtgtccaagtgttctcactgttcaattcccacctatgagtgagaacatgcagtgtttttttttttttgtccttgtgatagtttgctgagaatgatggtttctagcttcatccatgtccctacaaagacatgaactcatccttttttatggctgcatagtattccatggtgtatatgtacagtggcatggtcttcttgcagttctgtttgttgaggtcagcattagtgaatgttgcagggttcctcagcaggtaaggctattgttttctttagcagtggtgaggatgttggggttttcagtggtgaagcctgttgggatcttcttgatttttttttctcccacctggaaagtgtggctgagggaatctttcttggtcttgagtctggtttgtggatgcatttacaatggcagtggaactggtctctaatgcacagtgacagtggagcaactgtgaagctggggcctgaagcttgggcatatggggagcaacagtggcttcagaaccaggggatgggctagctgcttgtggtggtgtagccattgtgtggagcattgacttgtgcagaggtcacagttccaagcctcatggtgtgggctagctcacagtggtggtgtctctagtatctgatgtgtagaggggcaaagtgcagccatggagttggggtctggagtgtgagcatgtgaagagtgacagcagagctggggactggggagtagactatttctctgtggcaatggcttagatgtccaaggcgtgagtgcttgtggagtggctattataattttttttgaccaattcagaggtctgagaaaccaaaattataagctgaggaatcaacaaaggtaaacatagtttacatacatatctaatgattctaagtgatttttaggtgtaatataaacatattacagtgagctgaggctctgtaatatagggagaagttacttcaatttggttgagatagagtatgaacacttatcaagaaaggggttttgaagtccatactcttcctcaaactacttttttgtgataagactgaaaaaatttggctgagctcacacatccaaacaccaggaaatcacttggttcaagaactttttttattcactttgaaatcatgtatgagtttagatatttagaaaatattcatattgtctgagggttaatgccaaggcaaatatgcaacttaaagcactttttcatgatgccctctctggtaagttgacaattagatgtgccaaccacctagctcttggccagaagcttacatttggccttttgtgaatataaatgaagataaaggtcaaatattttggactgggaatttttttttctttttattttattattattatactttaagttttagggtacatgtgcacaatgtgcaggttagttatatatgtatacatgtgccatgctggtgtgctgcacccattaactcgtcatttagcattagatatatctcctaaagctatccctcccccctccccccaccccacaacagtccccagagtgtgatgttcctcttcctgtgtccatgtgttctcattgttcagttcccacctatgagtgagaatatgcagtgtttggttttttgttcttgcgatagtttactgagaatgataatttccaatttcatccatgtccctacaaaggacatgaacttatcattttttatggctgcatagtattccatcgtgtatatgtgccacattttcttaatccagtctatcattgttggacatttgggttggttccaagtctttgctattgtgaatagtgctgcaataaacatacgtgtgcatgtgtctttatagcagcatgattcatagtcctttgggtatatacccagtaatgggatggctgggtcaaatggtatttctagttctagatccctgaggaatcgctgcaccgacttccacaagggttgaactagtttacagtcccaccaacagtgtacaagtgttcctatttctccacatcctctccagcacctgttgtttcctgactttttagtgattgccattctaactggtgtgaatgatatctcattgtggttttgatttgcatttctctgatggccagtgatgatgagcattttttcatgtgttttttgggtgcataaatgtcttcttttgagaaatgtctgttcatgtccttcacccactttttgatggggttgtttttttcttgtaaatttgtttgagttcattgtagattctggatattagccctttgtcagatgagtaggttgcgaaaattttctcccattttgtaggttgcctgttcactctgatggtagtttcttttgccatgcagaagctctttagtttaattagatcccgtttgtcaattttggcttttgttgccattgcttttggtgttttagacatgaagtccttgcccatgcctatgtcctgaatggtaatgcctaggttttcttctagagtttttatggttttaggtctaatattgaagtctttcatccatcttgaattaatttttgtataaggtgtaaggaagggatccagtttcagctttctacatatggctagccagttttcccagcaccatttattaaatagggaatcgtttccccattgcttgtttttctcaggtttgtcaaagatcagatatttgtagatatgtggcgttatttctgagggctctgttctgttccattgatctatatctctgttttggtaccagtaccatgctgttttggttactgtagccttgtagtatagtttgaagtcaagtagcgtgatgcctccggctttgttcttttggcttaggattgacttggcgatgtgggctcttttttggttccatatgaactttaaagtagttttttccaattctgtgaagaaagtcattggtagcttgatggggatggcattgaatctataaattaccttgggcagtatggccattttcaagatattgattcttcctacccatgagcatggaatgttcttccatttgtttgtatcctcttttatttcattgagcagtggtttgtggttctccttgaggaggtccttcccgtcccttgtaagttggattcctaggtattttattctctttgaagcaattgtgaatggactgggaatttttaaactaaagcaaaatttgtattgtttttttggcaattactaagtgttctacttaagttgtcttttttaaaaaaattttatgtcattttttaaaattttacctccagacacgtagaaacagtaacagctgatactatacataataatgtataatgtgtctccatttttcctaactttgcccagtcatttatttctttttataattactctactgtccacatcttttcatgtacgcaaagcatatggattgaggacatttgatgaggccactgaagggcaggtttcccacagcccctgggcccctgacttcaggatatcaggagggctcagagccagcaggctagtggctgccagcttagtcagtcagggtgataatgggactctgcctcaatctctccacagtgagggctctgttggttgaacagtgaccccaaacaacagtctctagaaagtcttctactctctgaacagagtcaggtttatttttgctatttaaatctattaataatattaattttctgctgactatacaaatagttcactatcattgtagaaatatttaaaaatgcagaaaaattaagaaaacctatgacttgcaaggaaatagccattgttaatatattggtaggtttatttttattttatttttaatttcttcttatttttaatttttgtgggtacatagtaggtatatatatttatagggtacctgagatgttttgatacaggtatgcaatgtgaaataagcacatcatggagaatggggtctccatcccctcaggcatttgtcctttgagttacagacaatattttgatatgtttctttttaacttctgtctatggaaaaagacaaattataccacattaaattagatataactccctaaattagatcattttatacatggtttagcatttatacaatacttttcctacctaactttttttcaattatctttattttcatttcaatagttttgggggaacaggtggtgtattgattgcatggaaaagttctttagtggtgatttctgacatttgggggcacccatcacccaagctgtgtatactatacccaatatgtagtcttttatccctcaccctcccacccttccccaccatccccaaagtccactgtgtcattcttatgcctttgcatcctcatagcttagctcctacttatgagtgagaacatatgatgtttgcttttccattcctgagttacttcacctagaataatggtctccaacttcatttaggttgctgcaaatgccattatttcattctgttttatgactgagtagtattctatggtatgtatatacaccacattttctttatccactcattggttgatagacatttagggtggttccatatttttgcaactgtaaattgtgctgctgtaaatatacatacacaggtgtctttttcatataatgacttatgttcctatgggtagatacccagtagtgacattgctggatcaaacagtagttctacttttagttctttaagaaatctccatactgttttccacagtggttgtaccagtttaccttcctatcagcagtgtaaaagtgttacttttaccacatccatgctaacatctgttagtttttgatttttaaattatggccattcttgcaggagtaaggtgatatctcattgtggttgtgatttgcatttccttgatcattagtgatgttgagcattttttcatgtttgttggccacttgtatatcttcttttaagaattgtccatttgtgtcctttgcccactttttgatgagagtatttgtttattcttgctgatttgtttgacttccttgtagattctggatgttagtcctttgtcggatgcatagtttgctaatattttctcccactctgtgggttgtgtctttactatgctgattatttattttgctgtgcagaagctttttagtttaattaggtctcatttatttatttttgtttttgttgcatttgattttgggttctttgttgtgaactctttgcctaagccaatgtttagaagagtttttccaatgttaccttctagaatttttatggtttcaggtcttagatttaagtctttgatccatcttgagttgatttttgtgtaagatgagagatgaggatccagtttcattcttctacatgtggcttgccaattatcccatcaccatttgttgcatagggtatcctttccccactttatgcttttgtttgctttgtcgaagatcaattggctgtaagtatttggctttatttctgggttctctattctgttccatttatctatgtacctgtttctataccagtatcatgatgctttggtaacgatagccttgtggtataatataaagccgggtaatttgatgcctccagatttgttccttttgcttggtcttgctctggctatgcagattctttttggttccatatgaatttttggattattttttctagttctgtgaagaatgatgatgggaattgcattaaatttgtagattgcttttggcagtatggtcattttcacaatattgattctacccatccatgagcataggatgtgttttcatttgtttgtgtcatcaatgatttctttcagcagtgttttataggtttccttgtagagatccttcacctcctcggttaagtatatttttaagtatttttgcagctgttgtaaaagtggttgagtttttgatttgattcacagcttggttgttgatgtattgcagtgctactgatttgtatacattgatttcatatactgaaactctcctttctgtagcagttcccattcacccctggactctgctcaagagtgtttgcacccagtcaaaattattacaaagttcagttggaagcttctttcaccctgtgacccctgaagacccatgtgagatatagtcagtgatggctggggttgagctggagaatgtgagtgcctacaagtctcttcctactgctgcttttacttttatattttacactaaatttgtttcagctctaggtaaggttaaatcattctctcataatctggattttcaggttcctcagcggggatgtgtgttcagaggcaggttttcctcctctcacactttgggaactcacagttttttgactgtcatatggaatcttcagtggcctgtcatttctttccaaaaatctgtgatttcttttggttttcctggtaggctcctacagtggtttctagagcaaaagtcaatggtgtgagtcttcacatgccattttctctgtccaagtgggagctgcaggtcatacctgcttcctatccaccatcttcccccctcaattcctttttacctaatgttatattaatatcatgaacatttttgcaatattaactagccctcaaaaacaaattcttactggctgctaatacttggatatatagatacagtataatttatgtgatgatttttcatggttgagtatctcagttattaccaatattgactattttcacgtaaccctgcaatgcccagtcctgtacacaaatctttctgtgcatctctgatgagttttgaactttttatcatggaagatgccaaatagatacaaaagagggaagatttagtaaaatgaaaccttctttgcacactgtatgcctcaggctgttttgaagtaagtcccagatgtcatgcatgtgccaacatatacctcaaaaaaaggactatttaaaaatcatagcaattctgtcattatcacacctaaaataattagctataattcctcaatgtcatagtctttttagatagtggatttttagaactgatggtcccttcctaatatggctcttgatcaatattactttctagcaaagctttaaaatatgtacttccaaaacagtatatgcaaatttctaatgcttggcattttgactcttcttggtttatcatatttttaaatattgaacagggtaaagggctaactatggggaggcagtagagggaagtggcgattcacttacagtctctggagcaggcagtgtgggcatgtatctgggtcctacttgctacttgatattattatatctttgattgcatagtctcatcttcagcaacagcaattactcataggtcaacacgttttgtaaactaacttcacttctgcatttgctttagtttttttttgctttgattacgtttactttaatttcacagaggtattaagttagaggtgtattagttgctaagaaatgaaaaacacaaaatgctaagacatcaaaaacaggtaattcaactaatcattaatggtgctcccagtttttgcctattatgaacaaagttgcaatgaacacattctgtgagcagaggcttttcctttgttttgattacttcttgaggacagctttctacaggtgggattacaaggtcaaagggcatgacatttttttggaggggagggaatctcctatagctatttatgacctgttttctaaaacatttatatgtatttacactgccttctgcagacctgagcttcctttcatctttggaaatatcgattctcacctggaaaatagttatattttttctaaacagctaaattatgataccacatattgtttgattactagcagaataaaatgttttcctcctatgtttatttattaatttcatcttgcattttggcgatgagtaaatgaaaagaaaagcgaaatctaggataaaaatgtaacaagagaagtgatgaaatggaaactctcagagtgctgagttgcgctttgagtgctatcaatgaaatctatagacaatacattatttgtaagctataagaaaaatgatgagctctgtggtaggaaacatgtgacctctgccatgatagaattcactctactcacaggataccagaaactggaatgcttcatagaagaagggagatcaggcatagagaaagcaccatttggagcagcacaagaaaggggatttcagatgcctctgtcctcacttctgttgcttcagactgagtcttcacatctcacctgggcccttgtagtggcctcctatgcttttgttgttttcacctctccacatgcaatctgttttctttaagctgcttccacaggtatttctaaaacacaaacatgtacattgtcaaatgtgtctgcctacttagggttttagaactttgtggactacctctgatgaggaaatttgtgagccagcacaagacttctgaaatttatttggaaacatgtctgcagattgatggttggctataaaccaacttctccctagaatttatagctcacattagatcttgaggtcaagaccacctagttagttcttagaatggcagtttattgccttgacagagattttaacaactattttgtactataaatcttttgataagaatggtcccacctgttttactacttgaacatggttcagaaattgcagagtataaaaacagtaatatttgtcaacaattttaatgtcctcttttcaaccacctatgtatttattggcaatacatgctgtgttcagcacaatgtgaagagttttgggaatttggggaaaactagatacaataatattgctttcatccttattggaaaggcaaaggatgcatataataaaatgaaatatcatggcttaataatagcatataataaggtgatatgattaaaaatcagaaatatacgtaacagctaacccttagtgcttactatatgccacaaattgtgctaaacactttgcattaattatcttgactatcagatttaatttttacaactactctatgaggtacatgattaaaggtcacatgcaaactataaattcagatgcactcaatcactaatttgctcaagtccagaggagggagaaatcatttctagaatttctatggaagactttaagatgagatagaatttgaactgtatttgagggctggttaaaaattggatagacaaatgtaagtgggatgctatttaggtaagagatgccatgagcaaattcccagaggcaaggatctaaggaatgttactggcagagtgttccagaattatagagaatttgaaacggataagagaaaacagatgaagatatataggccgggaataaaatatatatgtgtacaactatgacttccaggcagtgaatcctcacttttccacttgagtttggaagaaaaaagaattaggttcttgagcttttctgattttacccttagccttttggtaggctactatctactgaaatcggtcctcagcagcaggtcatattgggaaattgtcttgccatgtagtctctgttggagtttgagtagatatccacaaccttgaggtagagttcagacgttcttgaggatgttatttggaaaccctcttgatttttggaatcaggagttatggtttgatcatcctcctcatgccatggcaatgcatcacacaaagtagtagttttgctactttatgttcctacccctagatgagtactatgtggtagaccgtgcatgcatgggttgtagtaatcactctgaaaaggaaataaactgtgtggatttctggcattattcttggaaacttttctctttgaactataggttttctgaaatgacccttctacacttaatgttacttagagtcccgatatttctctgctgcttagtgtagtagttaggacttcagatcccagagctgagttgtctgagtacaaatcttagctgctccactggtccattttttttttttttaaccactagcatgagccttcccctctctgattagttttcttatctttaaaatggtgatagtaattgtatctaaattatagggttatagagattaaataaaatgcacagtattctttccatctgctttcaggaatgtatttgagattgggtcattttgcagatggaacgatgatttattgtactttcatcttacagatttataattacatcatcatttttttcttttgagatggagttttgcaattgttgcccaggctgcaatgcaatggcatgatctcggctcactgcaacctctgcctcccaggttcaagcgattctcctgcctcagtctcccaagtagctgggattacaggcgcctgccaccacacccgggtaattttttgtagttttagtgcagatgaggtttcaccatgttggccaggctggtcacgaattctggaccttaggtgatccaccagcctccgcctcccaaggtgctgggattacaggtgtgagccaccacacccagtcaatatcatcatttatttttatttttattttttataagacggagtcttgctctgttgccaggctggactgcagtggcccgatctcagcttgcagcaacctccgactccctggttcaagctattctcctgcatcaacctcctgagtagctgggattacaggcacttgccaccaggcccaggtaatttttgtatttttagtagagacagggtttcaccatgttggccaggatggtctcgatctcctgacctggtgatctgcccaattcggcctcccaaagtgttgaggttacaggcgtgagccaccgtgcctggccaatattaccattttctatttttttttccccatgaaaacatcactgtaatttcatatgtcaattaattctccctttcttttttttctttttttttttgagacggagtcttgctctgtcaccagctggagtgcagtggtgtgatctcggctcactgcaaccttcgtctccctggttcaagcgattctcctgcctcagcatccccagtagcggggactacaggtgcatgccaccaggcccaggtaatttttgtatttttagtagagacaaagtttcaccatgttggccaggatgatctccatctcttgacttcgtgatcctcctgcctcagcctccaaaaattttccctttctttatacttttactacttaaatttagcacctttttgctattacttaaaaagccttcaagtttaaccactaaaatcaataacatatacgcatctgtatgttgtatttagagtgatgaattctgaaaacaataatatacctctttaaattataataataacatggcttatattactctgtttcagatgggttctctagctatggtataattattatgtttaatcacccctaacttattttattttaaaattatatttgtttttatattttgaatgtatatttagcaagtagtaaatataaagaaacactttaaaaatcactatctggagatatttgagattatgctaaatttgcagtttcttgcaggttatctttcctgtatcctggtaaactagagttttttttttttttttagtatttattgatcattcttgggtgtttctcagagagggggatttggcagggtcgtaggacaatagtggagggaaggtcagcagataaacatgtgaacaagggtctctggttttcctaggcagaggaccctgcggccttccgcagtgtttgtgtccctgggtacttgagattagggagtggtgatgactcttaatgagcatgctgccttcaagcatctgtttaacaaagcacatcttgcaccgcccttaatccatttaaccctgagtggacacagcacatgtttcagagagcacggggttatagattaacagcatcccaaggcagaagaatttttcttagtacagaacaaaatggagtctcctatgtctacttctttctacacagacacagtaacaatctgatctctctttcttttccccacatttcccccttttctattcgacaaaaccgccatcgtcatcatggcctgttctcaatgagctgttgggtacacctcccagacggggtggcggccgggcagaggggcccctcacttcccagatggggtggccaggcagaggtgccccccacctcccagacagggcggctgccgggcgggggctgccccccacctcccagacggggtggctggccaggcgggggctgccccccacctccctcccggacggggtggctggctgggcggagacgctcctcacttcccagacggggcggctgccgggcggaggggctcctcacttctcagacagggcagccgggcacagaggctcctcacctcccagacggggtggcggttgggcagagacactcctcagttcccagacggggtcgcagccgggcagaggcgctccccacatctcagacgatgggcggccgggcggagatgctcctcacttcctagatgggatggcggctgggaagaggcgctcctcacttcccagactgggtggccgggcagaggggctcctcacatcccagacgatgggcggccaggcagagacgctcctcacctcccagacaggttggcagccgggcagaggctgcaatctcggcactttgggaggccaaggcaggcagctgggaggtggaggttgtagcgagccgagatcacaccactgcactccagcctgggcaagatggagcactgagtgagccagtctgcaatcctggcacctcgggaggcggaggctggcagaccactcgcggtcaggagctggagaccagcccggccaacacggcaaaaccccgtctccaccaagaaatacgaaaaccagtcaggcttggcggtgcccgcctgcaatcccaggcactcagcaggctgaggcaggagaatcaggcagggaggttgcagtgggtcgagatggccgcagtacagtccagcctcggctcggcatcagagggagaccgtggaaagtgggagacagagacggggagggagagggagaggggaagagggggagagggagagaaggagagggggctaaactagagtttaattgcactgaattaattctgttttttaactgtccctatttgtactcattggtgactctcataatttaggtggcatgggacattcactagagctgtgattatacatctgctattgagaactctattctgggaagtttgagttctaaatttgatttttttttaggggaaaaagctgacattgtttttgattagtttcgatttgagaaatattgagtaatacttgcattttgatgcttcttggcatcatgtgcttgatatcctcaatattattctattatgtcttttagaatcagtccttgttcctccttcctcccattaaaatctaatttgggtactttgattagatcttcgagtctcttgacaaacaaactttttcaatttctgagatgtaccctgtctgaggaatgtatcattgttttataaaccaaagtccaggaagccaaactctttcatttttatattatgcatgtggagcattattcctttcctgtcgtgtttcctctctcctgcggtaacagtcaccaagtgatagagctgccaaagccactagctgggcttgtaagactttctgctctactctgagtttcaaagtatctggagatgctttctagttttcctgattccattcagctctacatcgaaggtgtgggtaggcagtgatgggtgagtctgctaactgtggctgtggctcggacggattgtgccgggacgtgtctggaggccgtcatcctgcggcgtgcagcttggccgcttggctgtgggaggtcagctcctcacatcctccctccaggagggacagcatgccttcttttcatccagtatattcttttttttttttttttttgcttactgagaattctttatctagcaaaacattctatcataaatgagtcctccagtttattctacgtggagcagcctcatgctgattagtgggaagtaaccaacacaaagtctttctctccatgaacacttggaggtttgcagagcgtgagatggtttctctgagggagtctgaagctctctcctataactcagagtttctcctttcttcactattatagtccttcacttgactaccagcttatagtcatctctgttgacccttcagaatattatttcctagcttcttttgatatttttgtttctaattttaaaagaatattcactgtcttctcctgcttggcttatcatagcaaaattgccgagactgggtggcttaacagaaacttattttctcacagttctggaggcttgaagtcaaagactaaggtgccagcatgatcagtttctggtgagggcccttcctggattgttgacagcttttttccccactgtgccctctcatggtgacagagagggggctttcttcttataagggcactgatcccattatgagggctccaccctcaagactttggctaaagctaattatctcccattggttacatctccaaataccatcacattgagggttagggcttcaactttggggggacacaaacattctgtttatggcacgcatgaatctctaaagaagacatgtggagaaacattcctcaccagctgggagagcagctgagctgctcctgtggccatgacagaatacgcctctgttatactgcagcccgctgctcagtgtatttgattagctcctttgcctccctcctagactgtaactctttcaaaacagagagtttgccttatttttcccacggcaacacagtatctcatcaacgttgtttaatgaaagaataaatcagcagtctcagtcttaaacataaacatcccctaaatgttgtcaccatggttttgtcagggcccattttcttggctgaccttcagtttctgttggctttctcatccccatttccatgttgtggctgattttcctgtgctttataaaataggcgatgcaggaaaatgggccttttaaactgcttagcacagttcttcccctggctgctctggtgtattagcagttataggttattagcagtttcatccttctcctgcattcattttttatgacttatttttatgtttatatgtcacacaaaaggactaaagaagggccaagctcacttttatcatgtgtactcaccaaagcaagtttctcccattttagaaataagatctttgattgttaatctaagaatctttttctttttttcttaagcataattacacaaaattcattttattgaaaaccccacaaatttcaaaattgtgaaaacaacacccaccaaaattcaaagctgaatcaaactaaaagataatacaaccacacatagacacatacacattgaatgaagttggcattaattttacactttgatacattgggaattttcatagctgttacgtttttgagcttaaaaagataaaaattcttgtctctgaatcaataacaccaggaaataaaatataaagcaaagtagcaaattatgttaaaaatgaaagggttgtgaatccagacattaaatatggccaagtgtgagctattttatttccttgagtgttgcaagtgcatgaagcatctctgatttctcaagattcaatatgaaaagtcagtcaagtagctggagttctatttctttgatgggaaattaggcaaggctgaagagcacagcagagcagcttttgcatatctttgaggtaactatggaaagggcatgtctctcattagtattggttacgaacaactcaacaagcctggaatatgacagatggggtctcggagctgacttaatactctagcatgacagcaactcaactgtgaaaacacaaaggaagttcagaggaacagacttaccctttctgcagcctggaagcactgttggttttgcttggctttgtattatgtcagagtgtcattcgcccttacctgagtagccttgtctccttgcacttaatgcactgctgtatttagcatttctacactgtctcagctgacttcccagtctcttttttgacttgtctagggcatgattcaaaatcttccatcaaagacagctccagccaagttcatttttatgatcctgttttgtgaagcacacttgatttttttcacagttcaacagatttaaaacatgataaagagtttggagggcagtgataatctatggacttgtgcagatctgtcaaggtgtcgagaggaagcaattgcttctttggtgagaatgatacattgcctgtaccctaaagtctatgaacagcattctaatggcaacttgacatttatcaaaagatttcagctttgtacctggctttatttgtgctcagccatcttgaaagttaggcatttgcagcagaattcaatagcagcacttctagtgaatgcgatattaactatttaatctggcaaactcatagctcctggatgtatgacacaacagacaactctttgtataggactaatagctgttagtccttttcaatgcaaaacacacaatactcagaattcttgcaggaacacacatgagaagccaagaggttataattttagaattaccagctgtgtctatactatgtcaaaatgtccacataaaaaggaaaaaatatctgttgtcagttcatagaatcagatgcttcttcatgttggatatatctaaaaatacatatattttcattttctggttctgggaaagaatttccaaagaaaagttagacagttatgctttgctgctggcatcagtttattcctgcatgcctataaaatataaaaatttactttagggagaggttagagggttatctaggcaatgggctaggtattaaggaatacaagatagatgaggtaagagcacagtctgggaggaactcaagtttcagattccgatgaggcagacagtcacactagaaaacacatgtaaaatatgtgtgattgaggaagcagaggaagatttcccagaagaggtgacatctgatatgcaactttaaaggtccataagcacttgtcaggcagacaaaggtcctgaaatgtaagagcatgtagccaaagtgcccaggcctcttgggactggataataaaagccacctcttgatggtggaaatagcttacaacttttatattactttttctttggttacctttaatggttataagataaataatacacacagaaaacttgttactaatcaggaaacctattaagaacatttttgtaagagaaaatagtaagattatttgttatgaaagcaagtagatatggatgagagctgtaaaggggttccaggcaatggagaactagtacacatcttattgcaggactagtgtgtatgtgtgtgtttatgtgtgtgtgtgtgtgtgcatgtgtgtgagagagagagagatttggagagacctctaagtggcaatgtgaaggacaaatttggacttgggaagggattgaaagttgggaagcagagtatattagtccatttcacactgctataaagaactgccagagactgggtaatttataaaggaaagaggtttaattgactcacagttcagcatggctgggaaggcctcaggaaatttataataacggcggaaggtgaagaggaagcagtgtaccttgttcacaaggcagcaggaaggagaagtgcctagcgaagggggaagagctctttataacaccatcagagccgggcgcagtggctcacgcctgtaattccagcactttggaaggccgaggcgggtggatcacaaggtcgagagctcaagaccatcgtaaccaacatggtgaaatccaatctctactaaaaatacaaaaattagctgtgcatgttggcgcacacctgcagttccagctactagggaggctgaagcaggagaatcacttgaacccaggaggcggaggttgcagtgagctgagattgtaccactgcactccagcctggttacagagtgaggctccgactcaaaaacaaacaaacaaacaccaaataaacaaaaaacaaaacaaacatcagatcacatgagaattcgttcactctcatgagaacagcatgagggaaccacccccatgattcaattaactccacctggtctctcccttgacatgtaggaattatggggattatgtggattacaattcaagatgagatttggttgggaacacaaagcctggccatatcacagagatacccatcaggaatctcaaatagtgtagataaagaggctaagtatatgaacaacagcgctgccaaaggaaagaaagaataaaaaattaagttgaggtgtttcactggtggaattcaccaaatatttattcattcattgaccaaacatttaatcactcatttgatatttattaaacagactgtatttttaaaaaacactttattgaggtgcaattgacatagaaaaactatacatatttaatgtacacaacttgataaatttgatgatgggtattcacctgtgaaaccatcaccgcaatccatgctataaacatatccatcaccttcaaaagttcccttctgctttctttctttattactacttttttgtgtgataagaacacaagatctatccttgcatcaaatttcaaacatacaatatactattgttaactactgctgtacgatagatctctttgactgattcatcgtgcacaaacaaaacatcgaaccttgtactaatatctcccattttcctctcccctcagaccttggcaaccaccattctactctctacgtctgtgaattggactatttcagattcctcatgtaagtaggcttatgcatatttttccttgtctggtttatttcaatcaatataatgtccttaaggttcactcttgttgtcatagatgccagaattttctcattttaaaagtcagagtagtattttattgtgcatatacaccacatttcttaatctagttatccattcatggacatttaggtggcttccatgttgtaactattgtgaataatgctgcaataaatgtgggagtgcctctgcaagatagtgatttaatttccttaggatagatattcaaaagtggattgctgcatcatatggtagttctatttttatttttttgagggttttttttttttttttgagacggagtcttgctctggtgcccaggctggagtgcagtggcgagatctctgctcactgcaagctccgcctcccgggttcacgccattcacctgcctcagcctcccgagtagctgggactacaggcacccaccaccacgcctggctaattttttgtatttttagtggagacagggtttcaccatgttagccaggatggtctcgatctcctgacctcgtgatccgcctgcctcggcctcccaaatgctgggattacaggcgtgagccactgcgcccggcccttttgaggcatctttagactattttctgtaataggtgtgccaatttatatccctaccaacaatgtacaagagttcccttttcaccacattcttctcaacactcatcttttgtctttttgctaatagccattttaacatggtaaggtaatatctcattgttttaatttgtatttccctgaagattattactattgagcatagttttttcagatatccgttgggacattttaatttcttctttgtagaaatgtcaatttgagtcttttattcattttaaaatttattttgttttattttattgctattccttacatatattggatattaaccccttatcggatgcatggcttgaaaacctttgctcccattctataggttcctttttcattttgttgattgtttcctttgttgtacaaaagctttttagtttgacatagtctcacttgtctatttttgcttttgttgcctatgcttttggtgtcatatacaagaaatcattgccaaagccaatgtcaataagacgctttctctgttttcttctagaagttttacagtttcaggtcttacatttagttaagtctttaacccattttgagtttttttttgtgtatggtgaaagataggggtccaatttaattcttttgcatatggaggtccaattttcctagcaccatttattgacaaggctgtcctttccctattgtgaagtcttggaacactgtcaaggatcagttgactgtatatgtgtaaatttatttctgggctctttattctgtttcattgtttgaagtgtctgtttttatgtcagaactatactgttttgattactgtagttttgtaattaggaagtgtgatgcctccagctttgttcttgcccaaaattgttttggctatttggggtctttgtgattccacatgaattttagaatttctttttctacttctgtaaacatgccattggaattttgatagggattatattgaatctgtagatcactttaagcactgtggtcattttaacaatattaattcttttaatctatgaacatggaatgtcttttcatctatttgtatctgttccaatttctttcatcagtgttttggatgcataagtgtttcacgttcttggttaagtttattttttgatgctattataaatgggatttttaaatttaatttccctttaaggataattcattgttactgtatagaaatacaacagatttttgtgtgttgattttgtatcctgcaactatgtaatttattagttctacttttttttttttgtggagacttcagggtttcttacatataagattatgtcattggcaaacagttttactgttttgttttacttcttccttttaaattttgttgtcttttatttctttttgttgcctaattgctcaaagacttccagtgctatattgaatagaagtggtgagagcacaacctaagctcatttcagatgttaaacgaaaagctttcagtttttcaccattgtgttgttagcgaaagacttttcatattttgcttttattttgttgagacaagcttcttctatacctaatttgttgagagtttttacaataaaattgtgttaagctttgtaaaatgctttttctgcatgtagtcagatgctcatgtgtcttctatctttcattctgttaatgtgtattatcttgactgatttgtgtatgttgaatcatctttgcatccctggagtaaatcacatttaatcacagtgaatgacccttttagcgtgctgttgaatacactttgccagtattttgctaaggattttgggatgtatattaatcaaggacattgacctatagttttctgttttgtctttatctgattttggtgttagtgtgatgctggcctcataaaatgaatttaaaagtgctattctttttaatatattttttaaaaatctaaaaagcattggtattagttctttaaatgtgtggtcagattcacctgtgaagtaatccggccccgggcttttcttttttgggagaattttacttgtttactctccttatttgttactgatcttttcagtctttctatttcttcttgatttattattgataggtcatatgtttctaggaatttacacattgtttccaggttgtacaatttgttggtgtataatagtcccttatgatcctttttatttctgtggcataaattgtaatgtcttctttgttatttctgattttatttatttgagtcttctcctttctttctttgtctagctagatgtttgttgatttttaaaaatctttttaaaaaacctgttagttttaccaatctttcttattatttttctattctctatttcactggtttctgcactaatcataattatttccttctgtctgataattttcgcttagttttttcttattttttatttccttgaggtataaaagtagattgtttatttgagatttttcctgtcttaaaatgtagatatttagcactataaacttccctgttagtattgcttttgctgcatctcataagttttggtattctgtgttttcatttgagttttaatatggtttggatttgtgtccccacccaaatctcatgttgagttgtaatccccagttttggaggaggggcttggtgggaggtggttggatcatgggggtggatttcccccttgctgttctcatgacagtgagtgagttcttacaacatctcattgtttaaaagtgtgtagcacctccccctttgctgttcttccttctccagccatgtaagacatgcctgcttcccctttgccttctgccatgattgtaagtttcctgaggccaccccagccatgcttcctgtacagccttgtggaactgtgagtcaattaaacctgttttctttatacattacccagtctaaggtagttctttatagcaatgtgagaagagactaatacagaaaattcgtacatagaagtggggcattgccataaacatatttcaaaatgtggaagcaactttggaactgagtaatgggcaaaggttggaacagtttggagggctcagaaggcaggaatatgagggaatgtttggaacttcctagagatttgttaaattgtggtgaccaaaatgctgacaatgatatggacaatgaagtccaggttgaggtggtcccagtaaaagtttggaaaatttgcaacccagccatgtggtagaaaagaaaaacccattttctggggatgaattcaagccagctgcataaattgtgtaagtagaggagagcaatggtaataaccaagacagtggggaaaatgtcttgaaggcatttgagagatcttctcagcagctcctcccatcacgggcccagagagctaggaggcaagaatggtttcatgggctgggcccatggccccactaccctgcacaactttgggacaatgctcccagcatccctgccactcctgctctagccatggctaaaaggaacccagatatgtctcagtctactgttccagaatgtgtgccagccataagccttggtggcatccatgtggtgttaagtttgtgggtgcacaggcagcaagagttgaggctttggagactccaccaaggtttcagaggatttgtggaaatgcctggatgtccaggcagaatcctgctgtagggtcagagcccttatggagaacctctactaacacagtgcagaggggaaatgtaaggttagagccccaacacagagtccccacttgggcactgcctagtggagctgtgagaagagggccaccctccttcagacctcagactggtagacccactgacaacttgcactgtgtacctggaaaagccacaggcactcaacaccagcctgttaaagcagctgcaggagttgtgccctgaagagccacaaactctttaggcagagctacctaaagccttgggatcccaccccttacatcagtgttgcctggatgtggaatgactttcatattctcaaatttgttaagatttttttgtgacctagcatgtggtttttcctagagaatattgcatgtgtgcatgagaagaatgtgtattctacttctgatggggaaatgtatgtgtctattaggtccacttggtctatggttttaagtctgctgtatggtgttatttaagtttgctgtttccttatacattttctgtctgacctattattttaatctattattgaaagtgaagtattgaggtcccctactactattgtcttttctatgtatccctttggatctgtcagtgcttgctttatatatttagatgctctgatgttgggggcatatatatttatatttgttatcttcttgttgaattgaccattttaaatttctataaagacattcttgatcttttgtggtagtttttgacttaaattctattttggctgctataagtatagctattcctggtttattttggtgatcacttgcatgaaatacctttttccaccctttagtttcagcctatgtgtgtccttaattctaaagtgggtcgtttatagacagtatatagtagaatcttggtgtttttgatcaattcagctactgcatatgtttggattgggtagtttaatccatttatgtttaaggtaattattgatagtaagaacttactattgccattttgttagttgctttttgtctgttttgcagttgttcctattttcatttttctcattttcctctataattttaatttttttgtagttttatgcttttattccttttactttttctcttgtgtacctactataggtattttatgtgtggtattataaggtttacattcaacatcttgtagttataatactgtattttaagttgatagtaactttacataaatcacacacaaatattctatacttttacttctttcctcactccacatactttatattaatgatgccacaatctacatcttttaatattgtgtatccactaacattttaaatttattcttactgcttttttcttttaacttttattctagaattaaatgtgatttacaaaccacattacagtactacagtattttgaattcgactatatatttacttttactggtgagatttatgttttcatatgctttcattttgttgtttaacatcctgttgtttcaacttaaatatgttcctttagcatttcttgtagggcaagtttagtggtgacaaactccttcagtttttgctctctgggaaagtctctatctctctatcattttttaaaaacaatttggctggtatagtattcttggttggcaatttttgttcttttaagcaccttgaatatatgatcacactctcctgccctgcaaagtttctgctaagaaatctgccaatagccttatggaagttcacttgtatgtattgagttgtttttttcttaccactttaaaaattccctctttgtctttgacttttgataatttaattataatatgttttagtgtagagtccttcgtgttcaatgtatttggagttctttgggcttcatgtatcaagatgttcatttccttccttagataagggtgttttagtcattattttttaaaataagccttatgctcctttctctttttctccttgtagcacttccataatgcaaatattgattcactttaagatgtactgtaagtcctgaaggttttcttcctttgtttttgttagttttattctttccattcttctgactagatcatttcaaatgacttatttttgagttcactgatttttttcttctgtttgatcaagtctgctattgaaactttattgagatgtttagttcattgtattcttaatatgttttttctttgttgaatatcttcttttatgtattgtgtttatgttttcttttagttgtctacttctgttctcttgtttgctgaacttttaaaagataattacttgaattttttttccatgaatttgtagctctccacttatttagggtctattactgaagcttcattttgttcctttgatggtgtccagtttccctgagtcttcatgatctttgtcactttgtgcatttgaagagaccttcacctcctgcagttattatagcctatatttggcaggaaaaataccttatcagtcaccttggccagagattctgagtcagttggagggtctgcaagcaataggcttggtgccagggactgtgggcaagtggacttgctgttggggcctcaggattgatgtctcaacatgtgctgggtgtggaaaactacccccactcttattagatcctcccaataatctagatgtaaaaattccctcaatatattctgaatgaggcattgcagaaacagaccttttagatagtgtccccaaatgctgaagatgtccaacattcactttgctctctgtttccttcacaggagaacttgtgggctgaggggatctttcttagtactacgctgtgctaacatgagggaggggtgatacagacaaagtaaaaccattctcttgcttttttaaatgcttcttttctcatttctgtggtccatcaaggtgctctaatcttcacttggattccaaagatctcataaagatattttcatccacaaatgtgtggatagtcattaaattagtgtttcttttggaggatagagctgagtccttttattctgccatctttctgatatcacttcaaactcagtctgtttttaaagcattgctctttgatgtatagaaagataattgcttttgaggggcttatagtctagtagaaaaattatgtgtgtgtttacacacacacacacagacacacacacacacacacagaaagagattgacgaggggagatttttaaggaggtaactaatgcagttgtgaggcctggccaatctgaaaaccgcagggtaggccagattctggggacacaggatagaggtgatgttgaaatcttgagtttgaaggtaatctggaagcagaatttcttttccctcaggagaccttgttcttttctttctttctttcttttttgagacagagtcttgctctgttgcctaggctggagtgcagtggcatgatcttggctcactgcaacctccacctcctgggttccagaaattctcctgcctcagcctcctgagtagctaggattacagacctgtgccaccccacctgcccctggctaatttttgtatttttagtagagacagggtttcaccatactggccaggctggtcttgaactcctgacctcaagtgatccacctgcctccacctaccaaagtgctaggattacaggtgtgagccactgcacccggctggtcttttcttttaagaccttcaactgactgggtgagacccactctcattacagtgagtaatctgctttactcaaagtctactgatttagatatgaatttcatctaagaatacctttatggcaacatatagactggtattcaaccaaaaactgggtaccatggcttagccaagttgacataaaattaaccattatacaaataaatgagagacagtattttgagtgtgtgtgaaaaattgtatttgagctgagctttgaagaaagagttgaagaagaaagaaatggaaggcacagcatgaaaataaagatgaaaatgagaaaaaatcagcatatgtatagaaaactatagagttcccttttattggcatagaataaatgaggaagggagtgatgaaaattaaacttgaaaagggagtcatgatattccatgatgactgggataagtagttttacttcattctaaagacaatgggaatccaatgaagtttttgctcagagaattgatatgctttaaactactgttgagtataagctggtagcaaatccaaatcaaggccatcatggagttgtctggcctctttggggcagctgttctcccttcctattgttacttttaaaatgatggtagaggataggattttacagagtcctttagatataatgtacaatatcttgtagataggtagggacatgtggaaacaggattttttccaagctagaatggaaattgtacttttaatgtatgtataaatattctgatccaaggatatttagttattggtaagtatagatacttttgcaaaaatctggcttccaaggccagactgataacttatcaggaatgttgtatagcatgaactacacagattctgcaaacctattaatatattcataacacttgtatgacctttgttttattgtcatgctgatattctacaaaatcatatatgatatgatagccaaaataggcagtcatgctgaaaagtttgttcttcatgagaaaaattcacgttttaaaagtaatagaaatttaattctgagccagcataacaactctttctatatgtgtaaatgtattataaaactagaaaaaacaaagcaaagaaaaaaaatttgtagttcctatcccttaaagccagaatggatacagaaaagtggaattttttgtttaattggtttctttttacctactcctttgctatttcataattccactttattttttattgacatcttagctcctctttccatgtgccctgcagctagcaatttttagaaacatttccgacaactctgggtctatttcttttctttttgcctttaaataactgttaggtcttattctctttccacttttaccctctgcaggtgactcttgactttaatttcttcttctgatcaaaacttctttgtctggatgcctccgcattagtcatgtttaaccttgatgttccctgagtggaatttccacaaacttttcagcatgcagtactttgtatggtttaaaaaattaaaatgtgaggccagttttgacaggaatactggacatgaagattcttttctgggtaatgctaggcgatctataaatgtgactgatgactcatgatgagaattatagaagtcaatagtacataataaaacctcatgataaagtaccttgttattccatggatttgataatattgcgggtcaaatcatttctctcaagagtggagtaaaatatcacaaatgtatgtccttaatgcagctcatacacttacgtgtcaatatttttcaacaaatatttgagtgcttactctatgtattgcatacgaatattatgagtagttttttttttgttttgaatttatgaaacatgtttttcttcccccaaaaataagagattagcttttggcacatcttcatagcagtttaatatggtaagatcttcaataacaaaggaaaatttaagaactcattgctcacttaagaaacatttacgaagtacctactctgtgtctaatctaacatcagatactgtagggaggtgggacatcctaacttcagcagtctgtcttagagagggaactgggggagagagaggaaataaactatcatttattgatcagtgttcaagatcactcacaaatgttttcacttaaacttaacaataacctcatgatatacttactattttctttctttgataacaagaaaactgagtctcagggtatttaagtaacaccccctaatgtcacaagactggttagaataggagaaaggatttaccttagttctgttttctttctgcacactacactggtcactaaaaggtagaaataaaaagtacaatgaaaataaatggttatagaaatttataatagtgtttttgcagaaaagaatacacaaaaaataaaggtgaaactgataatctattaaactgggaatcagacattttcttactgctcctgagatagtaaaagagactgaaaaacacattgtaaaaactctgaaaaacattcattacttgcttaacgcagaatttctcagattctgcttgttttctgttcccctacaccctaactctttatgtgttccatataatattaacagttgtgaaagtacaggatgaaaagttgttacatggaaattcccagtacaccacagttgttttactacacagattttttttatggtcctttttataggcatgagttatgggagactaccaattgttaagcaaaagctaagttttaaaatgaaaatgcatctgataactcctatagaatccaggcataggataataatagtaatctaaaacagacttggggatacacatacaatgcataaaagacttgtccaccccaaatttacttctctttcacttactgctgtcatttctgctctgagactagtatgtgtgtgtgtgtgtgtgtatgtaggtctgactttgtgagcaaatggttgaattcttcattatctgagaaaaagttctttttttctgatagtatgttaagtttggtaatgttagaagatgtaatagatgcattgaaagaggaaaccatttccagttaattgaagctggagtatttataccagctgctcttagtctcctctacattaagtgttgactccttggacacttgaataaccaataatatttaggctttatattctgacaatcatttacaatggataacataaaggttccttttttctcctccccaacttttttaaggtaaaattgacacatacaaagggtatatatttacagtatacaacataatacaacatatatgtagatattacaaaacgattaaatcaagcttattaacatatctatcatctcacatacttatcacttttttggggtgagaatatttaagatctactctgttgacaatttttaggtatgcaatacattatgattaactatagtcaccatgctctaaatagatttccatattttattcttcctgtctaaaacttagtaacttttgatcaacatctccctatttcttcctctctaggcagtctctggcaatcaccattatactctccatttctgtgagttcaattttttttggattatacatataagtgagatcatgtagtatttgtctttctgtgactggttatttcacttagcataaagtcctccaagttcattcatcttgtcacagatgacagaatttctttcttttgaaagactgagttgtatttcattgtctgtctatctattacattttcttcatttattcatcagtttgagatcctgattttattttctttggatacatacccagagaaagattgttgcataatagttctgtttttaattttttgacaaaccttcatactgttttgtacaatggctgtatcaatttatatttccattaagagtgtgtaagggctccctttcctccacatccttgctaatgcttattttttgtctttttggtaatagccacattaagaggcatgtgataatatctcattgttttaatttgcattttcctgctgattacagatatggagcatttttccatatactagttggccatttgtatgtcttctttttagaaatgtctattcagttcctttgcttactttgtaattggatttctttttctttctattgagttgtttgaattctttatatattgtagatattaactctttatcagatatgtggtttgcaaatatttttcctactctgtgggttatctcttcactctgttgattgtttccgttgctgtttgatgtaatcccatatgtctatttgacttttgttgcttatcctttgaggtcatttgcaaaaaccactgtccagacctatgtcaagctattcccctaaattttcttctagtagcttcacaatttcaggtcttacatttaagtctttaatccattttgtgttgatttttgtatgtggtgtgagacaagaattcaatataatttttctctaaacagtttttccaacaccatttattgaagaggctgtcctttccctattgtgtattcatggtaccatcgtcaaaaatcatttgaccataaatgtgtggatttagttctgagctctctattatgtttcatcagtatatatgtctgcttttaatgccggtatcatgctgttttgattactatagctttgtagtacattttgagattaggtagtgatgcctacagttttgttcttattgctcaagattactttggctatttgaggtctttcattgttttgtataaatttaggattgttttttctatttttgtaagaaagtcactggaattttgatagggatcgcattgaatctgtaaatcactttgggtagtgggatattttaacaatattaattattttaatccatgaacacaggctgtctttccatttatttgtatattattccatttatttcataaggttttatagttttcagtgtagaggcttttcatctccttggttaaatttattcctaagtattttattctttttcatactattttttcttaatttctccttcagattgtttgttggtagtgtatagatactcaactactttttgtgtgttgattttgtatgtttgattcaggtgctccaattttgaatgcatatatatttccaattgttatatcctcttattagattaacctattaatcattacataatagtcttctttgtacagtttatgacttctttttacagtttatgacttaaagtctattttgcctgatataagtatagctactcctgctctctttgatttccatttgcatgaaatagtattccatcccttcactttcagtctatgcatgtccttaaagtatgtctgcatattagtgtcttgtttttttgtttttctattcattcagacactatgtcttttgatgggaaaatgtaatctgtttacatttgaaataagtatagtctccctcggtatttgtggggtatttgttcccgggcctcctgcagataccaaaattcacaaatgctctgtcctttatttaaaatgttgtagcatttgcatataacctaggcacattctcttgtaggctttcatttacctttagattacctctaatacctaatgaaatgtaaatgctatgtaaatagttattataggtatatttttcaggaaataatgacaaggaaaaaagtctgtacctttcagtacaatcatccaatttttttcccaaatattttctatctttgcttggttgaatccacagatgtgaaacccatggatatggagggctgactgtattgataggtaaggacttactatcaacattttgtcttttttaaaaaaatgttttataggtcctttgttacttttttctgctttcgctgtttttctttgtgatttgatggtttctatagtggtatggtttaattcctttctctttatcttttgtgtgtttatgtttttattttgtggctaccgtgaggcctatgtatcttacagttatacaagtctattttaagcttgtaacaaattaactttaattgcatgcaaaagctcttcactttttattctcccttatatttttgatatcacatttaattttttatactgtgtatccattaacaagttattgcagttacaattctttttaatgcttttgtcttttaatgattatcctagagttataagtgatctatacactaccattatagtattagagtattctaaattggaccatgtacttttacctgtgagttttatacttttatgttttcatgttataattagtggtctttcatttcagctggaagaactttctttagtatttcttgtcaggcaggtctagtggtgatgaactacatcagcttttgtttttctgggaagtgtttatttctccttcaattctgaagggcaactttgccaggtaagatatatttggttagtattttttggttttagcactttgagttatcacctcactttctcctggcttgcgaagtttttgtggagaaatccactgatagccttattaagattctcttgcgtgtaatgttttttttttctcttgttgcttccaaaattctctcgtccttgatttttgaccacttaattataatgggtctaagtgaagtcttctttggcttgaatctgactggagacttttgagctttctatacctagatattcatatcttcctctgatttgagaagttttcaggcattattttgaaatacagcttctattcttttctcattctcttctcctttgaaactcctataattagaatattagttcctttgatggtgtcccatggtgtcccatagatttacataagatttcttcattgcttttcatttctttttctcctttgacaggatgatttcaaataatctgtctttgaacttgcttattttctcttttgcttgatctaatctgctattgcagctctctattgcttttttagttcagttattggattcttcacctgcaaaatttcagtttggcacttttttatgctttgtgtctctttgtcagtcttctaattttgttcttgtattttcttcttgattttattaaattatccatgttctcttgtagctcactgagcttctttaaaacaattattttaattctttctcaggcaattcaggaagtttattgtgttccttcagtggtgttgtttccctgattattcataatccttgtagccttcagcagctttttgcacgttagaagaagcagtcacctactccagactttatagactggctttggtaagaaaataccttcacttggggtgaggaagagtaggcgggagcatgctacactgggtctagtggtatggggaaccaagtatggaggctttcggtgtcttcaggtctgagagggtcatggtgtcttattggctcaggtagctggggttcataacgttgggaactacaaagttcttgatggcaaattggtgcaggttggccatggctctgagggttgttaggatcctcagtggtgcctcttcgtccagcagcaaggggccatggcagacaacagtgggggctggggctgacagtgtgcatacactctgctgtgggagctggctacaggcccatgcagggccagttgcaggcacatgcatagtggtaagggccagggctaggtgcaggagttggagctttctctgggtccacatatgacaccaggggccaacagtgtgtgtgtgtatggctatggaagtcagagctagcagtgtgtatatatgattgtaagagaaagcagcaggttggtgataggggccaggccatctgtgagtgtctgcacagctgcagggcctgagctggtggcatgctggcacatggctgcagggccagatgcaagctcagtgatgagggtgaggactggtaggcgagaatggttgtgtgcttatatgcagctgttggggcagaggccagctgcaagcatgtgtgcagctgcagtggccaactataggcatgtgtgtgtcagtaagggtgggtgacaggggtcacacagttttatgcatatacacagctgcagggactggagctggagacatgtagatgcatgactgtagggaccagcttcctagctctagcatgcctccagccatatcacaagcaacatgttggaggtttgtgtccaagttcagggtatgctgcttatgcatactcactagtaggggctgtgactggtggcatgcataagcccaaaggtaggggtcatttgtggacatgaacagaatgatgggtttggggactgtggtggagtcctggagattatttgtgagcatgtatatggtgtatgtgttagatccttggactgggaagcccatgtcagcagtagctggggcagcttcagtgttgggaaggaggaagacagaaggggattgtatctcaggaacctggacactgcaaaatattcttagttcttggtggaaaaagttgaaaggggtccgctgtggctgtgctggctgttggttttctcactggtgaaagttgctggtgttccttgttaagcaagcttccagggtctgcaacagtaaacgctgtggggtccttggtgataaaaactacagaaagtacacagcagccatgacagcagctgagatcctcagcaaagaaagctgcttgagtcctgtgcagaggagtccactgggaactgtggtgactcccattgtgtgggtgacactaataacccccttttccttctttgtttctagctgtctccagacatctttgctatgccagtcttcctagtaatctgggaggggtaaaaataaagctgtttttttttttttttgagatagggtctcactctgccatgtcatataggcctaagtacagtggggcaatcatagctcactgcaactttgacctcctggattcaagtgatcttcccacctctgcttcccaagtagatacaactacaagtgtgtgccatcatactcagctaattttttaattttttgtaggggtctcattatgttggccaggctggtcttgaactcctggtctcaagtgattctcccaccttggcctcccaaagtgctgagattacaagtgtcaggcaccatgcctggcctaaagctggtcacttgaagtgtttcaaaaggctgaatgaactggttgttcacccactcttcttttctctgagaaggggacttgtgaaccagagaattctttctccatacttagcaatgctgacatgggagagggggagatgcaggtaaaataaaactattgtaattatgcatttgtgtggttattctcaggtttctcttctctcactgtatagctgtcgcttctcaaatggactcctgaatttttttcagttatttttgttagcatagtggtacagtatttgttctttgttggggggtccaaggctgggatctcctagttcactatctcattgacatttctaaaagttctttttgtttttttttcagttgcaagatttaatagagtgaaaacagaactcccataaaatgggaggggacccaaagggggttgccgctccctgctcaaatgcctaggtttatatcctgatcattgtccctcctgctgtgctctcaggcgatataggatttgactatttctttacctcatgatttagcctaatttgtattttagtgagccctctttactacctgattggttgggtgtgagctgagttttacaaggtgggtgtggtcacctttctcagctaggcttaggaattcttagtcagcctaggaaatccagctagtcctgtctctcagttccccctctcaacagaaaaacccaagagctgttggggaggttggctgatgactgctcttaactgcttgctgctgaattggggcatagtaggggttgtgcagttgagatttcctggagaggagtgccttcaatgtcattaacattggagcataggctagcaggctgatccaggggtccgcagtagatcttagtcgtggactgcatctgggggtccatttgaagaacgatttgtagttttacagcttcgattctggaagagacaaacttaacaaggaggttaaagatacagggattgaaatgtatggcctgaagtgcaggggcatgtgggtgtgggcggtgaaagtgggggttcctttagaaaaactcctatacgatggggcatcaatatttctgggaagccgtattctccatagaagatcttggtaaggggagctactggtagtacagcagcatggaggaggtgcagtgagagtgaaagttttggtgaagggttttaagtaatttccattggttagctgcaggcaaaagtatttttcattcttctgtggctagccatcctgaggggaggaaactatgtccttgtgagtttccccattctatttcttctgctgagtactgtggcttggtttcccggaggggattatcccatactaggggtccttctataagtttttctaatggagggtcccaccttgtggctcttttggcttcaatatccacttggcgttttccttctattttctttcctttcctttctgatgaccccagcagtgtaagactgccacctctttaggtttctgtacagccaagaattgtctcctaatggcctcctgatgtttggtaggtgttttctcggaagttaggaattccctttctctccatattgctgcgtggacatggaggactaggtaagcatacttagagtctatatacatatttacccttttttcttctcctaattctagtgcccgagtgagggctattctgccaactgagcactagttcctggagtaaggggattactttcaagtattccattattactgaccactgcataccccgctttttgaagtcctttttctacaaagaaacttccattagtatacaagttgaggtagggatcagtcaagggaacctctagaagttctcctcaatggcgtaggtttgagcaatcacctgttgacagttatgttctgtctttattgtttggaagaaatgtggctgggttaagagttgcacaagtgtgcagtcacagcacaggccctttaagtaatagagcctgatatttaagcaaatggttgtctgacagccacaagtctcctttagcagtgagtattccatttacatcatgagatgtccacacagtaagatctcttccctgtattattttaactgcttcagatactaagactgctactgccgccactagccataaacaatgaggccgaccctttgccactacatcaatttccttacttaggtatgccatgggttgcaagctggttcctcgaacctgtgtaaggactcctagagctatttctgttttgtctgtgacatataaagaaaagtcttaccctgttgtcaagcttaatactggggcttgggttagggccttctttagggcctggaaagccacttctgcttcagatgtcgatcttactaaatgggtattggctttctgagtttccttaattagtgtatataatggcctggctatttcgctgtacctgggaatccatatatggcagaagcctgttatgccaaggaaccctcttagttgctttagggttttgggatgaggataagccagtataggctggacacattccttactgagggctctggtgcctttggataattttagccctaagtatttaacctgctgtgagcagagctgagcctttggtttggaaaccttgtagccacaggtggcgaggaaatttaagagcgcttgggtggcttgatggcacaaggtttctgaacgggtggctaaaaataaatcatccatgtaccaaaggacaagagtgtccagatatgagaactggctcaagtcttggactaatgccttgccaagtagatgggggctatccctgaacccttggggtaaaacagtccaggtgagttgagacgttgggttcaaaggatcttcaaaggcaaacaagaattgagagtcaggatgtacggggatgcagaaaaaggcatccttaaggtccaggactgtaaacttctctgcttcctctggtatttggggaagcagagtataaaggttaggtacagctgggaatggagggacgatggcctcattgataatcctgagatcgtgtactaacctccactgtccattgggtttctgtactcctaaaattggagtattgcaagggctattgcatggttttactaggccttgggcttttaggtccttaacaatcttttggagtccttgttgggcctcgggtctaagggggtactgcctttggtagggaaaggaggcagaatcctttagtttaacttgaacaggatgggcattctttactcatccatattgtccttctgttgtccagacttcaggattaattccttcctcaagcaggggacaacaaacagttgttgcttctcctatgttcaggtgtataacagccccttcttttgctagaatgtgtctccctaacaagggattggggctttcaggcataattagaaaagcatgtgaaaagagtaaagttccgcagtcacaacttagtggctgggagaagtatctagtgactggctgtcctaggatcccttggatagtgatagattgggaggacagttgtctgggacaggagagtaagactgagaaggctgagccagtgtccaggagacagttaaccttctggccctcaatggtcaagcatacctgggtctctgtgagggtgatggcatgggctggcacttgcaccaggcaccctcagtcctactgctggatcatctggttagtggcttctgactcagaggaccttcatcccctggggaagtgggcctccaactgattcccttgacataaggggcatggacgagacggtggcttattgctattcaaacaatcttttttaaagtgtccttgtagactgtactggaagcaagcccttaagcattcgatttgctcaggctttccatgttccagagcctccaaagtctgcttgcctgagggccatgactaaagcagtggcctttttttttttttatctcgtttgtcctgttccacctgctcctcctgatctctattataaaaaacccaggttgccaagttcaatagggtttttaagttttgctccaggcctaaggcagacttttgaagtttttttaaacgtctgccgctgactgagtgataaacttatcctttaaaattagttggccttcaatagagtcaggtgacagagaggtatgcttccttaatgcctcccttagcctgtccagaaaggcagtaggattttcttcctttccctgtgttatagtggacatcattgaataactcacaggcttcttcctagtttttgttagtccttctagcacgcaagttagcaaatgtctgcagcaccaatctccttgttctgattctgcattccaacgagggtttacactgggaactacctgctggcctgtggggaattgttctctttcctctgttgtcatcctatcattgacctgactgagacaccagagatcgccaaactctcgggctgcagttatggtggcacttctctcatttggggttagtgtctgatctagcagtaacattatatctctccatgtcagattcaaggattgtcctaactcttgtaaaacatcaatatagccatcagggttgtttgagaatttacctaggtctattttaatttgctttaagtctgacagggaaaaaggtacatgcactctgactgggccgaattctccagaatacatcttaggggcatttttgccaaagggagaatgtttcccatctgaaaaaaaaaaaaaaaacatagggatgccagcacccctagtcattttccaatgagcattagtcctagagcatcctctatggtcctaatgcttatttctttccagggtgcataaccacccatggacctctgcttattggattacttacactcactgatgtagcagtcctgcacatgttttcccgcctttctggaccacaaagaaaggggtctaggctgctggattctagtggtcctttaccagcttgcccaacattgcctttgcactcaggggtgagttctagagctgggctgtgttcctgagtatttcataacaacccagctgccctatcagtatgcattcccataaacaacagttcttatgcaaatttgtttcagagagggtgtagtaaggattttgagtaaggattgagtaaggattgagatagagttttttgattctgtaagtactttaaggcttggctgagtgcaaacagcttgcacatttgagcagaccaattattacgcaattttcctaactctgtttccacaagagtctccctatcaattactgaatacccattgtggttttttttctcaatcactgggaggagccatgtatcttcctgtcctgaagggagttcctcttaggtctggtcgtacctttctatggtaattaagatttaaatcccctgttaggaaatctgctaggttaagggatttttcagtggttaatgtaaaatcacctttttctaacagaacagccccatactttaagatttttgagttagtaagctacctttttgcttttttgacttagaataattttgaactggtgaggtgtgctcacaatgaggtttcctctaaaagttacttttctactttgttcctttagcaaagcagttgccactacagattgaatgcatttgggccatctgctggttcctgggttaaggatttttgataggaaggctactggttgtcagtggtttcagtgttttcaggctatgccattgtttacactgacaaggtagtattggagtgttacagggtcatggagatgaccttcaattatcaattataggttttaaatttaccccggcttttaaaagaatagggcacactgttttttctttactactctatctctttttctctctctccttctcttttctctctatgtctctctctctctctctctctctatctcttctctccttgacttactcaattcactttcatcctgatctattatgttgtcatagacccatttccagttgttaaagtactgggccatcagttctaaggccctggccaaggagccaaggcttggagattgtattgctgaggggtaagctgggtagaaatcaggggaggagagcatcttacacaatgggagagcaatcctcctagccatttacaaacttggggccctggcaagggtggtggggaacaggtcccatataactgcccatgtcgagagctgcatgcctaaattgggagagacaccagggacaagattccctgggttcatagcctagatgcctagggacagagcatagagcttctttagatcccttgggagatacaacttgctctaatacttaggagaggaaatgaaagtctgaaccattagtacctaggaggcagggatcagaggaagtagattcagaggtacggagaattttcgggctacactttcaaaaaagtcatggttggggcccaggaggtatgggtcagaaggaaagggttgcatgcatgggcgactgttgagtagagacttctggctgcgccacgatctcaaccagctaatgggaggagttcgggatgacagctttctgcctctagtcggccctcagcttccccaggaaaattgaaagtggaagctggttccaggcagaccaacgctcccaacccagaagggttgggggttgttagaaagccctttcccagagagcctcacacctgggtcttaagtccggtggccacactaattgtttttaactagctgacaggtgccggtattttcctccaattctgaggaaggataggacagaatagcaaatgaaagtggtcccgtattacccaccactttggaagtccctttgtggtcaccaaaatgttaccaggggggtggtccttgttcttagagctcccaagatggtggtgggccacttccaagatggcggcaagcctcttgttctctgacctggagttcttggcctcacggattccaaggaatggaattttgggccatgcggtgagtgttatagctctattagaagccgtgggtcacagaagagatccatggaacatagtgactagtattcagctcgattaggatgaactgattaggatgaaccagggcacttagccatgcaggaacaatgatgaacctttagcccgaatgggagtggcaatgggtgcctcactggatcaggagcacagtggacaccctgccagatctggagggtggaagtcagtggtgggtctgcaacagcggcaaacagcagtggtggatggtgagcaaaagcttgagctgtaacaaacactggccagaagagtgtgcagttgcaaggtttaatagagtgaaaacagagctcccataaaatgggaggggacccaaagtgggttgcctgacatttctaaaagttcttgttccaacacaataggtggcaaactgcagctgcctgtttctataaatttgttttattggaacagagccacacccatatgttgatattgtcagtagtgactttcatgctaccctggcaatttagtagttttgactatactgtctggaaagccaaagatagttactgtctggacctttaagaaaaatttttctgatccctattggaagtactcagacttcacctatgtttacttacctggactcttctaaaaataagtaatctcacacttgaatttttcagagctaatgttactttaataactttccttgtaatcatattttaaaatagtttaaagtattttgaataaggaaactaggaataaaatacacacagtttattgatttcctcttcccacaaatttgctactatatgcttccaaataataattctctttcacataagctcatctggtctcaattttaaacataaaattttcaaagagggtatagtgaacaaaaatgtgatacctggcaacatggaatgagatgaaatttagtctgtgggtttcaattaatattctataaatccttcatatcctttgcctctttgtcccagtatacagttttttttgtttgttttgtttatttttttgaggcaggatctcagtctgtcacccaagctgaagtgcagtgatgccatcacagctcactgcagctttgacttccctgggctcaggtgatcctcctgcctcagtctcccgagtagctgggactactggcatgcaccatcatgtcccactaatttttgtagttttttttttgtttcaccatgttgctcagtcttgtctcgtacttctgggctcaagcaatccatctgcctcagcctccaaaagtgatgggattacaggcgttagccatcatgtccaactatatagagtcttaagatgttaactattctctgtatttaccccattatatttcggttttaccaattttctgaatttaacactcctatcactattatttgcaaatggtgacaaaggaaaatcctgctttggaaatgattgaggattttaataagctcaagttttgactccttgatacttgagtaacagacaattcctagagtaatgtgaaagacaatgaactccatcaagtcttttagatttcttggtagtagaagtcagtggaaatcaacatatgtgatacatataaacaaaggaaacttagggttgttttctaacagaaaccatatttaaacatttaaaattatgttttaaattcctcatgtctacctttatttttttaagccacagaatgatatgattgctaaaagggcactttacaaagctggagaaatttattgtctagtaatatcagtattaatataataagaacatcatagagaggttcagaaatctgttttaagatgaaacctcatatggcagaaggaaagaaaccacaatctggagaatttaattggaacaagtatctagttttaattacagttttgcaaatgtgcagctataataactacatttccttgatgtatattttcataaggaatccataaaataaattcaaaggcaagcagattgctatcactaataacatcatttctccttagaaacagaatacaatttctaaatattgttttgtgaaaaacagattaatggccccgtctgaaggcaccatacaacatttaagtattttctacatttcttgtttgaaatgtctttctttatggcttttatcaaagggttagaaaaaagtaatcccataaagatacttgattagcttggttaatttcaatatctctagtcttctctagatggcagtcatgctacagggatttaaaaactgttcttgttgaaatccacattaagaatgctccagaatttctgtatctgggttttttttttgtttgtttgtcacagtcctcaaataatgctgatgagaatgttaagcctaggaaaatgacagaactgtgataaaatagaatggatatagtgaatgatgcacatcttagggctttacattgggacatgaaaacaaggggcataaagagtacatagagaatgagggaaaataaaatccacagactaaaatttgatcctagtctatgttgccagctatcacatattttgtacattgtttcctctttgaagacttcaaacttaaaaaatgaagccagttgttatgtgaaggagaatgactatttggaagtgcatgaatttgaatttggggcaagagaaaatccaatcacattttatatatcttctgcattccattcttagtcttctatatccagaggacttccagtcactaaaaaacacaattaaaagcaaagtgtcattaatgcaacattggtttttgagaagctctagtgcaatgtgaggattgagtccaggtaaacttagatgaaattggtgctccttaagagcaaaagttattgcttttaaaagctggaggtatcgtgctacctgactccaaactatactgcagggctccagtaaccaaaacagcatggtactggtacaagaacagacacatagaccaaaggaacaggatagagggcccagaaataagactgcacacatgcaactatccgatctttgacaaacatgacaaaaaaaaaaaaaaaaaagcaatggggaaaggattccctattcaataaatggtgctgggataactggctagtgatatgcagatcgagactgaatcccttgtttatgccatatacaaaaattaacacaagatggattaaagacctaaatgtaaagccccaaattataaaaaccctggaagacaacctaggcaataccattcaggacattggcatgggcaaagatttcatgacaaagatgccaaaagcaattgcaacaaaaacaaaaattgacaaatgggattgaataaacttaagaacttctataaagagcaattatcaacagagtaaacagacaacctatagaataggagaatatttttgcaaaccatgcatccaacaaaggtctaatatccagcatctatgagaaacttaaacaaatttacaagaaaaaataaaaccaaacaattttatacaaaagtgagcaagggacgtgaacatttttcaaaagaagatatgcatacagccaacaatcatatgaacaaaagttcaacatcactgattattagagaaatgcaaatcaaaaccacaatgagataccatctaacaccggtcagaatggctactattaaaaagtcaaaaaataacagatgctggtgaggttttggagaaaaaggaatgtttatacactcttaatgagattgtaaattagttcagccattttagtagacagtgtggtgattcctcaaagacctaaacccagaaataccatttgacccaacaatcccattactgggtatgtacccaaagaaatagaaatcattctattacaaagacacatgccgtgtatgttcattgcagtactattcaaagtagcaaagacatggaatcaacataaatgtccatcaatgatagactggataaagaaaatgtggtacatagacaccatggaatactatgcaaccataaagaagagtgagatcatgtcctttgcggggacatgaatggagctggaggccattatccttagtaaactaacacaagaagagaaagccaaataccacatgttttcatttgtaagtcagagctaaatgatgagaagacaagacacggacacatagaggagaacaacacacactgggtttttttcggagggctgagggtgtgaggagggagagaatcaggaaaaacaataatgggtactagcctggcttaatatctatgtgatgaaataatctatacaaaaaaaccccatgacacaagtttatctatgtaacaaaccttcacttgtatccctgaacttaaaagttaaaaaaagttattgttttatgataataatctttaacttgccgattttaagtgactttttgaatgtgaaccttgaggaaaatttatcacgtagcatacattcaacatataacaagtattttttgactgcttattatatagcaaacgctgtgcctagaaacttagcccaatagcctgatgaatgtatgctctgccagaacagataaactcgaagtcaaataggactccttttttgttgttttgtggttacagtaataaatggagaggaattgagtagatctaattagatttttccaccatggtgtctatctaggactgggatttaataaactaatgataatatcaacaaaaccacattaaataatttattgtatatgtaaatgggctacatgattcaaatatattatctatgcttattatatgaattcagaaaggtgaatactaatatcattatagataatgaaacttacagtaaaatggctttcccaggagcacaaaacagaaaaccaatttcagttggaatttttataactataaggcttatgttctcaccacaccatgttgcttcctattcagagctaccttattgtgtgcattaaaaaaatctgagaacatcagattgattctttcatgcagaggtgttgggataatacgtatgtcctttcacaggttgatttgtatttaagaagattgggaagatcaatgattaacttaataggctttctttctgatgatgaactgtttcagaatagtaacagagatgtgttgccatgaaaaatattttccttattacttatatgaagtatgccagtgactcttacctcactggttctgatgtaacttaaaatgtagcacaaaggaaaaataaaaaattacccattgctgaagaagtaaattccagtgcgatgccagcccctgcagtcccaggaaccaggcttgcacctgtgaactgtgattccaggccagagcttgtggaacaagaacccatgcccacccttgcagactcacgcttctagatagcccagtgttaggccagtccctacagtcttaagcttcaggttggctcacacagccccaagcactaacttggcacctgtgaacccagaacccaggtccacatccatgaactgagactctaaagtccacccacatggatccaagcaccagcccagcctgcccaaggactccagcagcaagctagccagtggacctcaatggccagcccacctagaatgcttggatacactgattggcaaatagcttttcctgccaaagctaatggataaagactgaaagaagtgtctactttctcaaatgtatagacaccaatgcaaggcctcaaaaattatgaataagcaaggaaaccatgacaccaccaaaagaacaaaacaaagaatcacaaactgaccctatagaaatggagagctattaactgtgaggtaaagaattcaaaacaggtattattaaaaactcaatgagctataacagaatgcagatagacaagaaaatgaagtcaaggaaacaatatgtgaataaaatgagaagttttataaagtgagaaaccataaaaaagaaccaaatagaaatttggagctaaaaagcacaaggattcagttgaaacatttcatgaacagcttcaacagtgacttgatcaagtagaagaaacaatcagcaaagctcagagacaggtcatttgatattatccagtgatatggtttggctctgtgtccccacccaaatctcatgttcaattgtaatccccagtgttgggggaggaacctggtgggaggtgattgattgcatcatgggagtggatttcctccttgctgttttcatgatagtgagtgaatttgcgcaagatctggttgtttaaaagtgtatggcacttcccttttctctctctttgttctgctttggccgtgtgatcatatgccttgcttcctctttgcactccgccatgattgtaaattttctgaggcctccccagccatgtggaactgtgagtcaattaaagctttcttcttcttatgttacccagtctcatgtacttctttatagtgtgtgaaagtggactaatacacccagctggagagaaagaaaaaggaataaagaagagtcaagaaaagctatgggacttactgagacaacatcaagtgaactgatgtgcacatcaggaaatcccggatggagcaaagaaagagaagaggcagaaagcttattcaaaataatgacagaaaacttacctaaagcttattcaaagtaataaagacagaaaacttccccaaactgtagatggaagtgaacattgagatccttgagaacttcaagtgcactaaacataaagagatcttcaccaagatacattataatcaaactctcaaaaatgaaaaaggtaactttgaaagtagccagagaaaaatgcctcgttatatacaagggaacatgatacactacattaacagaataaagaacagcagtcatgtaattatctcaatagatgcagaaaaagcatctgccaaaattcaagactattttatgataaaaattctcaaaaaatttagtatagaagaaatgtaaatcagtacaatgaaggccatatatgagaaattcacagctatcccattctcccttttttttactttaagttctgggatacatgtgcagaatgtgcaggtttgttgcataggtatacatgtgtcatggtggtttgctgcccctatcaacccatcatctaggttttaagccccgcatgcatgaagtatttgtcctaatactctccttcccctttcccgccactgcctgacaggtcctagtgtgtcaatattctactgcctgtgtccatgtcttatcattgttcaactctcacttatgagtgagaacaggtggtgtttggttttctgttcctgtgttagtttgctgggaatgatggcttccagtttcatccatgtctctgcaaaggacatgaactcattcttttttatggctgcatagtattccatggtgtatatgtgtcacattttctttatccagcctgtcactgatgggcatttgggttggttccaagtctttgctatagataacattcttaatggtttaaagttgaaagtttttcttctaagatcaggagcaagatcaaaattcctgttgtcaccacttatatttaatgtaagactggaagtcttagccagagcaattaataagaaaatgaaataaaaggcatccaaataaaaaaagttaacttctctgtttccagatgacatgatcttaaacatacaaaaatcagttgtgtttctagaaactaaccacaaattatctgaaaaggaaactaaggaacaatattatttacaacagcatgaaaaatacttaggaataagactgggtgcagtggcttatgcctgtactcctggtactttgagatgctgaggttggagaattgcttgagcccaggagtttgagaccagcctgagcaacatggcaagacccaatcactacaaaaaattaaaaaaaattagccaagtgtggtggggtgcacttgtggtttcagttacttgggagcgctgaggtgggagggtcacttgaactcaggagattgaggctgaagtgagctgtgtttgtgccactgtactccagcctgggtgacagagtgagaccctgtctcaaaacaaacaagcaaatcaaaacttagaaatgaactttactaaggatgttgaagatctgtacactgaaaaccaccaaacaatggtggaaaaaattgaagaagaaaccagcaaatggaaaactttcctgagtttgtggattgaaagaattaatactgttaaatgtccatactatgcaaagttatctatagattcatgcacacctcatcaaaattccaactacactttttatagaaacagaaaaagaatcctacatatatatggaaccaaaaagacctcaaatagcgaaagcaatcttgagcaaaaagagcaaagttggaggcgtcacactacctaaattcaaagtagactagaaagctatagcatacaaacaatatggctctggcataaaaacagacacacagatcagtggaactgcagaaaaatttcacgaataaatccacacatttatggtcaattgacttgtgacaaaggtgccaagaacacactgtgggggaaaggagagtctcttccactaatgttgttgagaaaactggatatttgcatgtggaagaatgaaattgcaccattatatcacattgtataaaaaaatcaactcgaggccagaagtgatggctcatgcctgtaatcccagcactttgggaagccaacatgggtggatcactggaggtcaggagtttgagaccagcctggccaacatgttgaaaccccatctttactaaaaatacaataattagctgggcatagtggcagatgcctgtaatcccagctacttgggaggctgaggcaggagaatcacttggacacaggaggcggaggttgcaggagccaagatcacaccattgcactccagcctgggtgacaataatgaaactccataaaaaaatcaactccaaagaaattaaagacttaaatgtaagacctgacattgtgaaactactagaagaaaacaggaaaaagtcttcttgacataggtctaggcaatgatgttttgagtatgacttccaaagcacaggcaacaaaagtaaacaagtgggactacatcaaattaaacagcttcttcccagcaaggaaagaatcaactcagtgaagagtcaacctatggaatagaagaaagcatttgcaaatcacttatttaataaaaagttgacatttaaaatgtaaaaagaactcaactcaatagccagaaaacaatctgagttaaaaaaaaggggcaaatgatatagatacatatttcttagaagaagaaatagactgtccaaaaggtatatgaaaagtatttgaacatgaataatcactggaaaaatacaagttagaaaccatatatttggcatggattaatatccaaaatatataagaaactcattcagctttatcaaaggaaaataaataactccaatttaaaaatgagaaaaggacctgaatagaactttctgcaaagaagacacacaaattgccaacacatatatgaaaaggtgttcaatatcactaatcctcaagaaaatgcaaaccaaaatcacaatgagatatcatctcacacttgttagaatggctagtatgtaaatgataaggtataacaaatgttggcaaggacatggagaaaagagaaccctaatacactgttggtaggaaggtaaattggtgcagtcattatggaaaatggtatgagggttcctcaaaaattaaaaacagaaataccgcgttatccagcaatcccacttctgggtatacatacaaaaaaaaatcagtatgttgaacggatatctacactcccatgttcattgcagcatttttcacaataggcaagatatggaaacagccaaagtgttcactgatagatgaaaggaaaaagaaaatgtggtatacatataaggcaggatcagaaaaacaaatactgcatcatctcactatggaatccaaaaagttgaactaatagaagcagagagtagagaggggattgccaggttttgtatggggtgtgggagaatgggaaggtttggtcaaaggatagacagtttcagtcagagaggatgaataagttctggaaatccattgtgcagcatggtgactatagttaatggtattgtattgtatacttgaaaattgctaagagagtagatcttaaatgttttcaccacatacacacacacacacacaactatgtgagatgatagatgcattaattagcttcatagtggtagtcatttctctctctatatatatatatcaaaatatcacattgtacattttaatatatataatttttatttgtcagttatatgtcagtgaaactgggaaaacaaagaaacaaaaattttcctttgtacttctaggtttgtgaaatttggtgaatgagtgtgcagttatggagacaatattgaagacattaagtagtatttctgcaacttctcttgctataaaacatcacaggaggaggttccaagatggccgaataggagtagctccagtctacagctcccagcatgagcaacgcagaagatgggtgatttctgtctttccaactgaggtacaaggttcatctcactggggcttgttggacagtggatgcagcccatgaagtgtgaggcaaagtagggcgggtcattgcctcacctgggaagcacagggagtcagggaattccctttcctagccaatggaagccatgacagacggtacctggaaaatcgggacactcccaccctaatactgcacttttccagtggtcttagcaaatggcacactgggagactatatcccacgtctggttcagagggtcccacacccatggagcctcacttactgctagcagagcagtctgagatcgaactgcaaggtggcagtgaggctgggggaatgggtctgccattgctgaggcttgagtaggtaaacaaagcggcaaggaagcttgaaccgggtggagcccaccgcagctcaaggaggcctgcctgcttctgtagactccacctctgggagcagggtatagccaaataaaaggcagcagaatcttctgcagatttaaacatccctgtccgacagctttgaagagagtagtggttctcccagcatggagtttgagattggagaacagacagactgcctcctcaagtgggtccctgacccctgagtagcttaactgggagacacctcccagtaggggctgactgacacctcatacagccaggtgcccctctgagacgaagtttccagaggaagaatcaggcagcaacatttgctgttctgcaatatttgctgttctgcagcctctgctggtgatacccaggcaagcaggatctggagtggccctccagcaaattccaacagatttgcagctgagggtcctgactgttagaaggaaaactaacaaaaaagaaaggacatccacaccaaaaccccatctgtacatcactatcatcaaagaccaaaagtagataaagcacaaagatggggagaaaccagagcagaaaagttgaaaattccaaaaatcagagctcctcttctcctccaaaggaatgcagctcctcaccagcaatggaacaaagctggatggagaatgactttgatgagttgagagaagaaggcttcatatgattggtaataacaaactcctccaacctaaaggaggattttgaacctatcacaaagaagctaaaaaccttgaaaaaagattagacaaatggctaactagaataaacagtgtaaagaagaccttaaatgaccttaaatggagctgaaaatcatggcatgagaactaggtgacgcatgcacaagcttcagtagccaatttgatcaagtggaagaaagggtatcagtgattgaagatcaaatgaatgaaatgaagtgagaagagaagtttagagaaaaaaaaagagtaaaaggaaatgaacaaagcctccaaaaaatatgggactatgtgaaaagaccaaatctatgtctgagtggtgtacctgaaagtgatggggagaatggaaccaagttggaaaacactgttcaggatgttatccaggagaacttcctcaacctatcaaagcaggccaacattcaaattcaggaaatacagagaacaccacaaagatactccttgagaagagcaactccaagacacataattgtcagattcaccaaagttgaaatgaaggaaaaaatgttaagggcagccagagagaaaggtcaggttacccacaaagggaagcccatcatactaacagtggatctctcagcagaaactctacaagccagaagagagtgggggccaatattcaacattcttaaagaaaagaattttcaaaccagaatttaatatccagccaaactaagattcataagtgaaggagaaataaaatcctttacagacaaacaaatgctgagagattttgtcaccaccaggctgaccttacaagagctcctgaaggaagcactaaacatggaaaggaacaaccggtaccagccactgcaaaaacatgccaaattgtaaagaccatcaaggctaggaagaaactgcatcaactaatgagcaaaataaccagctaacatcataatgacaggatcaaattcacacataacaatattaaccttaaatgtaaatgggctaaatgctccaattaaaagacacagactggcaaattggataaagagtcaagacccatcagtgtgctgtgtgctgtattcaggagacccatctcacgcagagacagacagaggctcagaataaagggttggaggaagacaaaaacaaaacaaaacaaaacaaaaccaaaaaaaaaaaaaaaaaaaacaaaaaaagcaggggttgcaatcctagtctctgataaaacagactttaaagcaacaaagatcaaaagagacaaagaaggatattacataatggtaaaaggatcatttcaacaagaagagctaactatcctaaatatatatgctcccaatacaggagcacccaaattcagaaagcaagtccttagagacctacaaagagacttagactcccacacaataataatgggagactttaacaccccactgtcaatattagacagatcaacgagacagaatgttaacaaggatatgcaggacttgaactcagctctgcaacaagcagacctaatagacatctacagaactctccaccccaaatcaacagaatatacattcttctcagcaacacatcgcacttattccaaaattgaccacatagttggaagtaaagcactcctcagcaaatgtaaaagaatagaaattataacaaactgtctctcagaccacagtgcaatcaaactagaactcaggattaagaaactcactcaaaaccactcaactacatggaaactgaacaacctgctcctgaatgagtactgggtacataatgaaatgaaggcagaaataaagattttctttgaaaccaatgagaacaaagatacaacataccagaatctctgggacacatttaaagcagtgtgtagagggacatttacagcactaaatgcccacaagagaaagcaggaaagatctaaaattgacaccctaacatcacaattaaaagaactagagaagcaagagaaaacacattcaaaagatagcagaaggtgagaaataactaagatcagagcagaactgaaggagatagagacacaaaaaacccttcaaaagatcaatgaatccaggagcttgttttttgaaatgatcaacaaaattgatagaccgctagcaagactaataaagaagaaaagagagaagaatcaaatagatgcaataaaaatgataaaggggatatcaccaccgatcccacagaaatgcaaactaccatcagagaatactataaacacctctacacaaataaactagaaaatctagaagaaatggataaattcctggacaccctcccaagactaaaccaggaagaagttgaatccctgaatagaccaataagaggctctgaaattgaggcaataattaatagcctactaaccaaaaaaagtccaggaccagatagattcacagctgaattctaccagaggtacaaggagaagctggtaccattccttctgaaactattccaatcaatagaaatagaaggaatcctccgtaactcatttcatgtggccagcatcatcctgataccaaaggctggcagaagcacaacataaaaagataattttagaccaatatccctgatgaacatcgatgcaaaaatcctcaataaaatactggcaaaccgaatccagcagcacatcaaaaagcttatccaccacgatcaagttggcttcatccctgggatgcaagcctggttcaacatacacaaatcaataaatgtaatccatcatataaacagaaccaaagacaaaaaccacatgattatctcaatagatgcagaaaaggcctttgacaaaattcaacagcgcttcatgctaaaaactctcaataaactaggtattgaggggacatatctcaaaataataagagctatttatgacaaacccacagctaatattatactgaatgggcaaaaactgggagcatttgctttgaaaactggcacaaaacagggatgccctttctcaccactcttattcaacatagtgttggaagttctggccagggcaatcaggcaggagaaagaaataaagggtattcaattaggaaaagaggaagtcaaattgtccctgtttgcagatgacatgattgtatatttagaagaccccgttttctcagcccaaaatctccttaagctgataagcaacttcagcaaagtctcaggatacaaaatcaatgtgcaaaaatcacaagcattcctatacatcaataacagagagccaaatcatgagtgaactcccattcacaattgattcaaagagagtcaaatacctacgcatccaacttttaagggatgtgaaggacctcttcagggagaactaaaaaccactgctcaatgaaataaaagaggacacaaacaaatggaagaaccttccatgctcatggataggaagaatcagtatcgtgaaaatggccatactgcccaaggtaatttatagattcaatgccatccccatcaagctaccaatgactttcttcccagaattggaaaaatactactttaaatttcatatggaaccaaaaaagagcctgcattgctgagacaatcctaagccaaaagaacaaagctggaggcatcatgctacctgacttcaaactatactacaaggctacagtaaccaaaacagcatggttctggtaccaaaacagagatatagaccaatggaacagaacagagccctcagaaataataccacacatctaagccatctgatctttgacaaacaaacctgacaaaaacgagaaatggggaaaggattccctatttaacaaatggtgctgggaaaactagctagccatatgtagaaagctgaaactggatcccttccttaccccttatacaaaaattaattcaagatggattaaagacttaaatgttagacctaaaaccataaaaaccctagaaaaaaacctggggaataccattcagggcataggcatggagaagtacttcatgtctaaaacaccaaaagcaatggcaacagaagccaaaattgacaaatgggatctaattaaactaaagagcttctgcacagcaaaagaaattaccatcagagtgaacaggcaacctacagaatgggagaaaatttttaaaatctacccatttgacaaagggctaatatccagaatctagaaagaacttaaacaaatttacaagaaaaaaacaaccccatcaaaaagtgggcaaaggatatgaacagacacttctcaaaagaagatatttatgcagccaacagacacatgaaaaaatgctcatcatcactggccatcagagaaatgcaaatcaaaaccacaatgagataccatctcacacaagttagaatggcaattattaaaaagtcaggaaacaacaggtgctggagagaatgtggagaaataggaacacttttacactgttggtgggactgtaaactagtgcaaccattgtggaagacagtgtggcaattcctcaaggatctagaactagaaatgccatttgacccagccatcccgttactgggtatgtaccgaaaggattataaatcatgctgctataaagatacatgcacacatgtgtttattgtggcactattcactatatcaaagacttggaaccaacccaaatgtccatcagtgatagactggattaagaaaatgtggcacatatacaccatggactactatgcatccataaaaaaggatgagtttatgtcctttgtcgggacatggatgaagatggaaaccatcattctgagtaaactattgcaaggacagaaaaccaaacaccacatgttctcactcataggtgggaattgaacaatgagaacactcggacacagggtggggaatatcacacactggggcctgtcatggggtgggggaaagggggagggatagcattaggagatatacctaatgtaaatgttgggttaatgggtgcagcacaccaacatggcacatgtatacatatgtaacaaacctgctcgttgtgcccatgtaccctagaactttaagtagaatttaaaaaacatttagaaacaaacaaacaaaaatcatagtattctactcagagcagttccttagtaggttttgtgattttgtcccccagaactcagtatggatgatgtggtaagaattgatattttctgagggtgtttttattagtttcttagggctaccataacaaagtgccacaaactgagtggcttaaaacaacagaaatgttagtatctcacagttctgggggctacaagtctggaattaagtgattggtagattcaatctccctctggaacctgtagggcagaccttctttcttcttcctagcttctgctgttttgcttcaatctttagtgtattttggtttacaggtgattaactccaatttgtgcctccatcttcacatggtgttctccctttatatcttcatgcctttacattgctgtcttcttataaagatagcagccatagtggattaggggcccaacctactccagtatgacctcatcttaatgaattgcatctgcaattatcctcttgccaaataagtttgccttcttaggtactggagagctgggacttcaacgtatcttttcagtgcaaactttcatttataactgtgagtcattaagcaaagaacagattctagtaccaactcatcattagctgtgtaattagcattaacacccgatatggtttggccctgtttccccacacaaatctcttcttgtagctctcataattcccatgtgtggtgcgagggacctggtgggagatgattgaatcatgggggtgggtctttcccatgctgttcttgtcatagtgaatgggtctcatgaaatctgatggttttcaaaaatgggagtttccatataaaagctctctttgctggctgccatccatgtaagatgtgacttgctcctccttgccttctgccatgattgtgaggcctctccggccatgtggaactgtaagtccagtgaaacctcttttttttttttttttttctgtaaattgaccagtctctggtatgtctttatcagcagcctgaaaatggactaatatagtaaattggtaccaggagtgaggtgctgctggaaagatacctgaaaatgtggaagggactttgcaactgggtaacaggcagaggctgaagcagtttggaggactcagaagaagacaggaaaatgtgggtaagtttgaaacttcctagagacttgtttaatggccttggtcaaaatgttgatggtgatatggacaataaagtccaggctgatgtggtctcagatggaaatgaggaacttactgggaactggagcaaaagtgactcttgttatgttttagtaaagagactggtggcattttgcccctgccttagatatttgtggaactttgaactggaaagagatgatttagggcatctggcagaagaaatttctaagcagcaaagcatttaagatgtgacttgggtgctgttaaaggcattcagttttataagggaagcagaacataaaagtttgaaaaatttgcagcctgacaatgtgatagaaaagaaaatcccattttctgagcacaaattcaagctggctatggaaatttgcataagtaagacaagacaatgcagaaatacccaagacaatgcagaaatataatataaatataggtataaataatataatatatatttaaatagtataaaaatattaaaataaataaatatatatgtataaaatatataaataatataaatccccaagacaacggagaaaatgtctccagggcatgtcagaggtcttcatggcagccccttccatcataggcctggaggactaggagaaaaatttggttttgtgggccagactcagggtccctgtgctgtgtgcagccttgggacttggtgccctgcgtcccagccactccagccatggctggaaggggccaatgtagagcttatactgtggcttcagagggtgaaagcctcaagtcttggtagcttcaacatggtgttgagcctgcaagtgcacagaagtcaagaattgaagtttggaaaccttggcttagatttcagagaatgtacggaaatgcctggatctccaggcagaagtttgctgcaagggcagggctctcatacagaacctatgctaaggcagtgcggaagggaaatgtggggtcagagcccccacagagtccctactggggcactgcctagtggagctgtgagaagagggccactatcctccagagacagaatggtagatccactgatagcttgcgctatgcacctggagaagccacagatattcaatgccagcccatgaaagcagctgggagggaggttgtatcctgcaaaggcacaggggcagaggtgtccaagaccatgggaacccatctgttgcatcagtgtgacctggatgtgagacatggagtcaaaggagatcattttggaacgttaaggttgaactgacccactggattttggacttgcgtggggcctgtagcccctttgttttggccaatttctcccatttggaatggctgtatttacccaatgcctgtaatcccatggtatttataggaagtaactaacttgcttttgattttacaggctcataggtgaaagggacttgccttgtcttggatgagactttggactgtggacttttgagttaatgctgaaatgagttgggactttcggggactgttgggaaagcatgattggttttgaattgtgaagatataagatttgggaggggccagggtggaatgatatggtttagttctgtgtccccacgcaaatctcatcttttagctgccataattcccacacgttgtgggagagacgtggtggggatgattgaatcatgggggcaggtcttttccgtgctgttctcatgatagtgaatgggtctcatgagatctgatggtttttaaaaacgggaattttcatacacaagctctctttgcctgctgccatccatgtaaaacctgacttgctcctccttgcctcctgccatgattgtgagacatccccagtcatgtggaactgtaagtctaattaaatctctttcttttgtaagttgcccagtcttggatatatctttatcagcagcattaaaatggactaatatacacctctcctgactttagtttcctcatctataaaatgtgggggttggaaaatttacttctaagggcctcttctaataacttgagaatgataaccatgacctcttgtcacatacctggggcccatgaacatttctgttaggacagggtatggctcatgaggatagaaatgatgaaacacctttctttctcccaagtcccaatctccttctttagttagttgctaggttttgagaatcctcaggatctgcaattttatttattgcagagtgccatgatgcaacaaagaaaaaggcataagaatggaagatctgatacataaacaagacacaacagatgtaaagaaaaaaaccaacaaaagtgactgaagctccaataggttaacagtgattgactttactactggcagaaaaacttcctgggctggcaagaattgagacaagctgcaagcactgacagaaactgtcattttagactaccaccctctcccctaagccagcataatgtcattcacaaagaatttccctagacatacagtttctgaggtgagaagagggaattggaggttaacgttcagtctccataccagtcttggaatcttgtgagaaatcccattctggtcctatctcacaggaaccctggaaagtgccaggagagactaaaaacttggggtgaattgaggataaagagcagagttctgatcacagctattggcacaggaatcttaatagctactcagtactttgatcagtgaggatgccatatagaagagactagctggtgtcatagcacttcaggtagcacaattcatgggaaagtccaaatccctagccatatttttcagaaagcttttccacaaagcactcccaggtgcttgtgtggagccttcttttgacttggaaagaactaaatggtcaggctgtgcacagtggctcacgcctgtaaccccaacactttgggaggctgaggtaagctgataatttgaggtcaggagttcaagatcaccctggccaacatggtgaaacaccatctctactgaaaatacaaaaattagctagagatcctgcacacctgtaatctcagtcacttgggaggctgaggcaggagtatcgcttgaacccaggagacagaagtttcagtgagccaagattgtgcctctgtactccagtttgggtgaaagagtgagactctgtctcaaaaagaaaaaaaaaggaactaaagggtcaggattaagttttggtgctcacttaagtttttccaaaccagagaacaatgcagggtagctatataggtctgaggcaatgggcgagatttcagggctcactataagtctttcccagaccagaaagcaatggcagggcagagatttagttccagagtagtgtttaagttcaggtgtttactacaagttatccccagaataggaagcactaacaagctggtgtttaagttttgatactgaggagtaaaggtctaacactaccaaagaacatatgcaaataatggaagaggtggcccaaatgtgtaagcatcaatgtaaagataaaaataattgtaaaaactcagagaaatatgataccgccaaaagaaatcaacaaagctccagcaatagatcaagaataattgaagatctagaaaatatttcaaaaagaatgaataacaatccccttaaggaagttcagggaatcacaagaaaatagaaataggaaattaatacgatttggaaaataacccaggaacaaagtgatacatatatattttttgagatggagtcttgctctgtgcccaggctggagtgcagtggtgcaatctcagctcactgcaagctccgcctcctgggttcacaccattttcctgcctcagcctcctgagtagctgggactacagcacccgccaccacacccagctaattttttgtattattagtagagacgaggtttcaccatgttagctagtatggtcttgatctcctgaccttgtaatccacccacctcggcctcccaaagtgctgggattacaggtgtgagccactgcgcctggctacaaagtgagaaattttaaaaatcaaaacaaaacaattaaaaaaatagaaatcctagaagtaaagagcacaataactgaactgaaaaactaattggaaagcttcaatgggagaactgaataaacagagggaagacttagaaatcttgaaggcagtacatatgaaattacacagaggagtaaaataaaaaagtaataaaaagtgatgaaggcctatgaaaattatgggacaccaacaagcaatcaaatcttcatataatataatttcctgaaagagatgagaaggaaaagtccatgaaagcatgttaaactattgtctgaaactttcctaaatctggagaaagatgacagttttcaggtactggaagctcaaaggtcatcaataaaattcagcccaaagaggaattccccaatgcctattataatcaaattagaaaaaaatcaaggacaaagaaaaaaatactcaaagcagcaagagaaaaaaatattacactcaatggagccccaatatatgtattagtaattttttcagcaggagccttcctgggcaggagagagtgagatgctatattcaaagtgctgaaagaaaaaatctgccaagcaagaatactttacacagcaaaacaactcttcaaacataaaggagaaataaagactttcccagacaaacaaatgatgagggaattcatcagaatttcagatcagatttatcttgtaagaaatgctaaaaagatgtcttcaactggaaagaactagatgctaatgtgtaaccagaaaaatgtccacaagtagaaaactcactgtttgaagaaaacagacaaatcagtaaaatcaataaaatactgtcattggggtaagtaaaccacttatatcttcattgtgaagactgcaagatgaaactattaaaaacaataactatgacaattgattaatagacccgcaatataaaaagttttaaatgaaaacattaaaaagtcaaaatgtgggaggagaatggtgttacagtgttgtttgtttttgttacttttctttttttgtgatcaaagtgaagttgttatcagtttataataacctgctataactataaaactgtaagatgggctaggtatggtggctcacacctgtaatctcagcactttgggaggccaaggcagttggatcacctgaggtcgggaatttgagaccagcctgaccaacatggagaaaccccatttctactaaaaatgcaaaattagctgggcatgttggcgcctccctgtaataccagctactcgggaggctgaggcaggagaattgcttgaacccaggaagtggaggttgtggtgagctgagatcctgccattgcactctagcctgggcaataagagcaaaactccatctcaaaaacaaacaaacaaacaaacaaaaaaaacccacaaaaaactgtaagatgttttctgtaaccacaaaacaaaaatttataattgacacactaacaataaatggcatggaatcaaaacatattactaacagaaatcacttaatcacaaaggaagatagtaagagaggaaaaaagaagaaagaatctacaaaacaaccagaaaacaggtaacacaatgggagtaatattctcttatctatcagtaataatcctgaatgtaaatgaatttaattccccaattaaaaaacagagtgactaaatgtataaaaaaggcaatgacacaaatatatatactgtctaaaataaactcacttcacctataaagactcttacagactgaaagggaagggatggaaaaagatattccatgcaaatggaaaccaaaaaagagaaggagtagctatactgtataagagagagtatactttaagtcagaatggtaaataaaagacaaagaaggtcattatatcatgataaaggaatcaaaacagcaagagaatataaaacttgtgaatatatatgtacccaacactggagcacccaaatatataacaaatattaagactgcaatacaataatagcaggaggcttcaacaccttatttttgcaatggacagcccatccagatagaaaattaagaaaggaacatcagagttaaactgcactctagaccaagtggacctaacagacatttacagaatattcaattcaattcttaatagcacatggagcattctccagaatagtctatatgttaggtcaaaaacaagtcttaataaactgacaaaaagtagaaatcatatcaagtatttctgaccacaatagaatgaaactaaaaatcagtaacagaaagaatattggaaagtattcaagtatacgtaaataaaacaacagacttctgaataacaaattggccaatgaagaaattgaaaaggaagttaaaaaatttcttgggacaaatgaaaatggaaacacaacatagcagaatctatgagatacagcaaaagcaatgctaagagggaagtttaaagcattaaacacctatgtgaaaaaagttgaaagacttcaaataaacgatgtaatgactcacatcaaggaactagaagtacaagaaatagcccaacccaaaattagtggaaagaaagaaataataaagataagagaagaaataaagaaaatggagatttaaaaaagtacaaaagatcaaccaaacaaaaaattgttttcttgaaaagataaacaaaatcgacaaacttttaggtagactaacaaaaaaagagaaaatccaaataaataaaatcagagataaaaaaagagtcattacaactgatatcacaggaattcaaagaatcattagagactattgtgaataccaacaaattggaaaacctagaagaaatagatatattcatgaacccatgaaacctatcaagattgaaccatgaagaaacagaagaggtgaaaaacaagtaacaagactgagtctgtaataagtctccaattaaaaaaaaaagacccagtcatgatggcttaactgctgaattctaccaaacacttaaagaagaacaaataccaagtcttcttaaattattccaaaaaaactgaagagaaggtaatacttatgctatagtatgggtatttgtgccttcaaactcatgttgaaatttgatccccaacattaaagatggggcctaagggaaagtagttgggtcttggagttagatcccttatgaattgcttggtgctgtccttggggtaatgagtgaattcttggtttattagttcccatgagagttcctccaacagttgatccttaaaaggggcctgtaaccttccttcctttcttgctttctctctcttgtcattgatctctgcacatgctccctgtgcttgccttccaccatgtgtggaggcagcctgaagccctcaccagaagtagatgctggtaccatgctccttgtacggtctgcagaaccatcagccgaatgaacttctttttctgtataaattacctagcctcaggttttcctttataacagcacaaaaatgaactaagatgacttccaaacttattctaagagggcagcattaccctaatacccaaaccaggacagaacacaacaacaacaaaaccctacagactaatatctctgaagaacatattattgttaaaatgtccatactacccaaagctacctacagattcaatgcaatctctatcaaaacaccaaggacattctttatggaaatggaaaaaaaagtctcaacatttgtattgaatcacagaagaccctgaatagccatagcagtcctgagcaaagagaacaaagctggaggaatcacactacctcacttcgaatatactacaaaactacagtaatcaaaacagcatgctactggtataaaaactgacatatggaccaatgaaatcaaaataaattcacacatctacagtgaacttatttttaacaaaggttacaagaacccacactggggaaaggatagtcttttcaataaattgtgatgagaaaactggatatccacatgcggaagaatgaaactagatctctaccattcaccatatatagaaattaaataaaatggattaaagactaaaatataagacctaaaactatgaatctgctagaaaaaacctggggaaatacttcgggatattggtctgggcaaagattgttttttgttttaaaaacaagacctaaaaagcacaggcaacaaaaggaaaaattgacaaatgggatttcatcaatctaaaagcttcagcacagcaaagtgagaaattaacagaatgtagacaacctacaaaatgggagaaaatatttgcaaactattcatctgacaaaggactaataatcagaatacataaggaacacaaatgactcaataggaaaaataaacaaataatccaattaaaaaataggcaaatgatctgaacagacatttcccaaaagaagataaacaaatgactaacaggtgtgtgtgtgtgtgtgtgtgtgtgtgtgtgtgtgtgtgtgtgtgtatttgagtcagagtttcactctgttacccaggctggagtagtgccatcctggatcactgcagtctcaagctcccgggcccaagtgattctcccacctcaaccttctaagtagctgggaccatgggtgcataccaccatgcttggctaatttttaaatattctgtagagactgggactcactatgttgcctaggctggtctcaaactgctgggctcaagtgatcttcccattttggcttcccaaagtgctggaattacaggagtgagccaatgtggccaaccccaaaaggtgtatggaaaaatactcaacatcactaatcatcagttagatgcaagttaaaaccacaatgagatatcatctcaccccaacgaaaatggcttgtgtcaaaaagaaaggcaataacagatgctggtgaggatatagagaaaggagaactcttgtacactgttggtctgaatgtaaattagtacagccactatggaaaatggtgtactggctccttagaaaactaaaaacagatctacaaatatgatccagtaatcccactgttgggtatatatacccaaaagaaaggaaatcagtatatcaaagagttatctgcactctcatgtttattgcagcactgtttacgatagtcaaaatatggaatcaacgtatgtgaacatcaatggatgaatgaataaagataatgtggtatatatgcacaattaaatattattcagccataaaaaataataaaatgctgtcatttgtagcaacatgaatgaaactggaggacattatgtcaagtgaaataagccaagttcaggaagataaatattgaatgttctcattcatatgtggaagctaaaaacattgattccatggaggtagagagtagaatgagggttaccagaatggtaaggtggggaggagatggtgagaggttggttaacgcgtacaaaaatacaattatataaaaggaataatttttggtgtctgatagcactgcaggtgactacagttaataataagtcattgcaaatttaaaaatagaagaaaagatttgaatgttgctaacacagaaaatgataaatgtttgaggtgataggaatccctgttaccctgatttgagtattatgcactgtatgagtgtaccaaaatattatgtgcaccccataaacatgtacaattattatgtatcaataaaagtcagtagaattttatcatattaataatgagtatacttttattttccccaagtaattatgtatattaaaacatgattctacaaacaaattttaaaagaacatttaagaaagcaaccacctatcatctttttaaagtggctttattgagatatatttcacaaaccataaaattcacccatttaaagtgtacagttcaatagttttagtatattcacaatagatcacattcatagttacagtagataacagtgtattcacattatttaacgatcactgtaatctaattttagaaaattttatcaactacaaaagaaactatgtagccactagcagtagtttctatttcttctaattcctatagcccttggcaatcatgaatctactaactctatatttttgcatattctagacattacatataaatgaaatcatgtacatacatgaattattgaggttgagaattcccatgatttgtcacatttgtcacctgcaaactggagatccaagagagctggtggtgtaattttggcctgagtctgaaggccttataactgatggtatactccaagtccaaaggcatgagaagaccaatgtcacagcacaacctggtaggtagtaagggaaagaattcttaatttccctgcattttgttctattcaggctctcaatagactgaaaaatgaccacccacattgtggagttaactttactttactgagttaatcagttcaaatactaatctcatctgaaaacactgttatagaccaaaacagaaaaacgtgtaatctgggcactcaatagcccagtcaaattcacactcaaaaggaacaattacatgagtgatcaccaccttttgacttgtacgcacggggcatgataatcaagtagtttctatattttcagaatttagtggtgaaaagatgtcaaattaaattaagaaatgagatataaagagactcaaatcctggcatttgaaaaagagctatttcttatttaaaattttcttgtaaatttctttataaagaagagtaataacaagttcaaagaagaaattaaatgataatgtgttttccattgaggattgttatagcttgggttagaaaaatctgtgaggaacaaaaaaggaaaacaagaaattacacactgctaatataggtgtgatgtttcaggtactaaaaataaatcaccttttctgatactgagaagagaaataccaaatgactgcaaatgatcataatatttacttttatttctataatttaaaaaacaaagattgagtaagaaagatagaacatagttttgatactcgtgtccctcaggtgctatcactaggaactaacaagacagatgattttttccagaattttctctctagagctggtagtaggatctgtgtgtaaggcactggttccaggaaaggtgagattagcagatatctttcattataactatacctttatgtcaaagccagctaaatgaaactatacactaaagttaaaagtttaaaaatactatgattatgattgaaggaccacttataaccacctttaaagaatagttttgtggctgggtacagtggctcatgcccgtcatcctagcactttgagaggctgaggcaagaggattgcttgaacccaggagtatggacaatgtagtgagaccctgcctctatgaaaaaaaatgtaaataaataaagaataactttgagttgatattaactctggggactcacaacactgcttaatacagattagaaaatattatcaggcaacattttataacagtaactattattgcagagaaaacattttgggaaaggtgaacaccagtgagaaagaaaaaggtagttgggttatatgagcacaagtctatagattttggaacagaattatgctgtattattatctaattatgtatccaaatcatcgtggtcaagtaaaagaagaaattcagctatagggagaggaggtggcaatatggggttttaaacaaaatctctatctctactcttatctatcttatgctgagaggtgcagggtcgagttatcctagatcttaacttaatgagagtcctggaggggaaatgggagcccagtggaaggagctagaggtgaaatcttggattttagggccctgcagacacacaaaccagaagagagtgaatgatccttattaaggggtctgcagaaatgaaggaatttcttaagaacccctacatgtaccaggtgccagaaatagtaagttcctcttctaagcttccttggtttttcttgctctgtgcacagcccttcctgcttagtctgtaatgagcacttgtttctctgcttaatctgtaactagcaaacctcttactctgtaaacaagccttcccacctagttggtaagggacagcctctgccttctcccctaattggccttactcaatttcaaatactagccaatcgggtcagcttagactgtgtggtctgactccagccaatggggaaaggactcagaacaggaactgtgttagggataaaaacccctgccctacctggctaggtgtgctcttgtgattgtgactgacacaggcagcacccttttgcagaagtagatgtgcgttgctgagaaattttctgcctaagttctggttttctttgcagcacccagcatttgtttctaacacagggaaagagtgagctggagaaacctctcaaattcaagaaagcgtaaagcaaattgaacaatacgggtgaggtaagaacttgacttctctaagtttttcccctctaccaccctcttcctaaaataattacaggatgtagaagctaagatgagtaggctaaggaaaaaattggtaggaaagaaagaagatgccagaagatgtcaaaggtttttgcttccagcagactctaactaaataaatgttaaattaatgtaaaaataaatatgggcttttgattattacatggaacaagatcatttaattttttaactgattggagtttaaaattgcagttacttaagattgacccctaagttttgagacttcccaagtctttattccaggtaagtgggaagatagaacattttagagaatatcttcactttaatcaggttgaaccttatatagctaacattttcttttgtctcaaaattatgagaaaggaaaatgtcatatgaactcagaaaagtaataggatctaaacttgaacaagtaaaaaaatcatgatttttcaattctcttgtgtatataaattacttagaccaatctttagcaaaaataaaatgagaactgttttataaacagtaaagcgtctacagattattcaagaaagaaaccttatctgtgagttctttgagaacaaaagcattttatgacagctgtgaactaattagtgtcattaggtattaaaaggcaagaacaacaaaaaacagtgagcagaccatatagagaagttagaggactggaaagaaattaggcatgatgtaaagtttaagaacagtaaaaactaaatatcatttgcattgaagaaaaggtgtttgaaaatgatgagttctgttttttgtttgcttgtttatatttttcttttggtaacttttcttacccctcccccaaaactgttaagtgcttcattagtaaacaacatgatggacagaaaggaggaacacattatgaatagttttggcttagaattatgtgttagtttataatagcatgtctaaaatttttgagttgtatgtaaaatgcttaagaatttttaataaaaaatcccagtgtgttgtgatatctcttgatctaaaatagctaacatctgaattttatgatttcatgcaacaattttatttcattcatgattttgtgggtcaggaattctggaagggccaggctgggtgattcatctttgctcaggttggcagcagtagaagctgtgggatacactcaagatggcttctccacccccatatctggtgccatggtgctccctggcctctctttctttccatacagcatttccagggcctctccaatgtggcctgggcttctcacatacaatggtttcaggataagtagctcagggctctggaagatcaagaaagagacactagttctcctacaggctgagtctggaactggagtggaataatctctgatgctctctattgtcaaagcgtagtccaccagtttagattcaagagagagaaatagattccacctctgcatggaaggagggtcagaagtttttcagctttcttaaccctccacactatagtttatcaacctttaagtttgtcgagccttctgagaatctgatgaaaaatatgggaaaatgcactttcatcacatttgtatgcaattttggtggaaacacttaccctgaagatttaatgtctaaaataagttgcttgatgaatggaattatagaaacagtatataatccttaccttgatgtcagatccattggtctgttcactaaatccctatcttctttgtcctcttcattcttctttaagcactcttgattttcgtctcctccaaccttaaccttctcttcctttcctcttgaggtctgtctttgaaaggatcttggttgtagttcagcagttataatttcacaaggttcatttctctcagggtagtaataaacttttaaagtatgactaggtcaatatttctctaaatgagctcctttgtccataatttatacccagtggcaaacactctgtgactagaaagacagaaaggaaataataccttgggacaatattttaatagccagatgtcattgccactaaccaatgtttaggctgtatacaagtataaccttgctgactgatttccaactcttatccaaactgtctacctggattttgtttcttgtcagccaccacaaatacaaaggttgtttctcaattttgttctgtaaacatatgattgctgcatcctccaggaattgaaattaagcatcccagctttgggaatatttttcagaagcaataaaagacttctttggctttgtctttttatgaggatgctttgcatcctgctcacatgccttgtaatgtaatctcaagacacagctgttgtttcagagagttcattcatgtcagcagcaattaaaaagtcctttgttttccaaacatgcttcccagcttgtcttgaggagctttgcaaacaatgactcctacagcttgaggaaaggaatccttattgtgtgtggcagaaagggtgtgtcatgctcattttcagtctcgttccatgatttaccacaggtacacctgtgcatcttcttgacagtgaagttttaaatatagaacattctcagtcatcactttgccaccttgagttatgaccccttgtagcaatgagttagagcatacttataagatgggatgaaaatcaaaccactcctttgatattacaagtgttaccctgcttatattttcattttatatatcgaaatggatgtatcctggagacttgagcttcagtagcttgatattgctttgcttttaggtgagatgtgtactataggacagtatctcaagggctccctgtgcatactttgtgtttcaggttatgggcacctggagaatgacgaattgaaagagagacatgtgctatgatttcagagcctcaaaaaggcaggttctttccctattggtcctgttttcctttctcaaaagtgaatgagtacattccttgtagaagattagagaaagtacacatggccttgtcttatctagccttttcacttgtagagtcgggtctcatgtgtattaagataaatcactgctatgatcatttacaaatattagtatcatgaatacatttgtatacctttcagattgctacacatagactatgtcttattttaatgatttgtgtgtgtttgtgtgtggtggtggtaggagtaggggtaactaaactggtactcaaataacacatcctttctgtttttggtcagtttctagacttctttttgctttggaacaagaggatgggatgaaggtgggagcagggaactaaggaaactgctaacataatgagctgaaacacacagccggggtacatgttttgccttcaccttttaaataatcagaatgagcatgtgacatctcaaatgaaatattcgtttacctaattgacaatgggttttatattttagcaaatatacaaaaaagtatagaatctgcactctagggaatacataaagatattatagaacaggacaaatatttcaaactcaagttccataagtctatagactctttaaagtctgctgacattaagataaggagtaatcaggtatatattaaagtagattttaaaaacgtgaagcttttgagtattttgcaagcctgttggtgaacacacatgtggactctgagccatgtgattaacgtgagctcaagcttttctcagctggaaagctgcccttagcaatagcatatccttcactcacaatgtctgaaaatccgagtaaaaggcaggcaaagtaatatgtaattaaaaagtgtttttcttattctgcctttatgaaagtgttgtaaccaagcgagttacagagaaacgccacactgtgagatgaattcaggattcctttattagctggcgaccaagaaatggctagcactcaaaattctcttggccccgaagaaagggctagattttcttttatactttggtttagaaatggaagtgggggagtctagttaaaacaatcttacagaagtaaagcaggcaaaaagttaaaaggataaatggttacaggaaagcaaacagttccaggtgcaggggctttagatctatcacaaggtgatagacgtggggctttgggtattatcaaccagatacaaacatgggggctctgggtgctattaactgggtgaattcctgggaactgtggatatagcttgccacagtaacttatcagtttaattgcattcttggatgtgctgggagtcagcttgcacaagttaagtccttgaggaaggaggatgggtaaggggctgcaagtgaaggagccaagatggagtttgtctggctcttttagctaagggagagtcaattcaggttaaaacaaggtagggtatcacaaaagaagagatccaaataatcctagttcatagagttagaactgatcttaaatcagctagtggaaaccttgctttgtgtaaaaggaggaagcagcaacagtaacagcagagagataagtgattgcctacacactgctcagtcagccaggatctgaatttaggtcttttgactaagccaatcctgaatatcaaattagaaagcctgagagaagtgtactaggtactttgtttttacatctttattgagataattcacccatttaatatatacagaactgggctgttttttagtgttgctgttgtttggatttgtatccccacccaaatctcatgtcaaattgtagtcctcagtgttggaggaggggcctggtgggaggtgattggatcatgggggctgattccctcttgctgctctcctgatagtgagtgagttctcacgaaatctggttgtttaaaagtgtgtaacacttccccctttggtctcttcctcctgctccagtcatgtaggatgtgcttgcttcccctttgccttccaccatgattgtaagtttcttgaggcctcctcagccatgcttcctgcacagcctgtggaactgtgagacaattaaacctattttctttataaattacccagtctcaggtacttcattatagcaatgcgagaacgaactagtacaaacctattcacagagttttggagttatcaccacatgtgaacatgactttagaacatatcaaaactcccaaaagaaaacctttctcctctagcagtcacttcctattcacacctaaaggcccgcctccaccctcgtcctaggcaagcactggtctactgtctgtcctgatggattttcctattctggacatttcatacaaatgggatcatttgacatgtggtcttttgtgagtagcttctttcacttggcataatattgtaatacttccatgttaaaatgataatccgtatttcatttttttattgccaaatagtattttattgtacaaacactccacattttgttaatctgttaatgagttgaaaaatcatataggctgttttcattttttggctattatgaatagtgctgttataaatattgtgtgaaagtttttgtgtgcactgcacatatattttaatttctcatgggtatatatttggaagtgaaattgttgggtcatatggtaaacctatgttcaatattttgaagaactgccaaactattttttcctagtttgtttttaaaacaatgtcacaatattatactaacaactaccatgaatcagggcgatgttcagctgattttcaaagtatataaccatccatatggaaaagttggtgtatattaatacatagttaaaaatcatgaagaggcacaagaaagtcctcatcattaaaataagactatgaaaagcaataatcatgctttctacattgtgaataatttgcatagtctacatttaaaccagccagtatataacaggcttttcgttggcagcaataaggatttggccaagttaatgctaatgtactctttcactttgcatttctagatatagaaaatggcaacaggtttttgataaagatgttaagatattgaaaaaataaaactaaaaatatcagcaggagagaagaacagcaccattaaaggaagggactggtcttagtactaaagttctctgaataccaactgcatcaggggtttggcagcagtatcatgcatacactgaagaaagcttttttgctgccttttgaagctgccttttgtaggtcttatgtataaacaaaccagattgaggctattcaattttttatctgtatttctcttaagacattttgacagcaattttttttaaccgtatacccagtaaaatagctggaatgtctaaatttaggtccaagacccattttttctctgagctcccccacaatccatgggacattactttgtatcctggaaccccaccttcacctgtggaacaggaataattatccacctgtgcacctaaggagatggggatatgtgataaaaaatgagctatgtagcacacagtactctgtgaactatttatttgtttatgtgttttgagacggagtcttgctctgttacccaggctggagtgcagtggcacagtctcggctcactgcaatctctgccgcccgggttcaagagattctcctgcctcagcctcctgagtagctgggattacaggtgcgtgccaccacacccggctaatttttgtatttgtagtagagacagggtttcggcatcttggccaggctggtcttgaactcctgaccttgtgatccacccagctcggcttcccgaagtgctaggattacaggtgtgagccaccacacctggccctgtactctaaactatcaagccctaaaaggtaaggcatttctatgggccaagtataactgtgcttattataaatgtttgaagggatattttaaatgttcagagcacttatgcttatttttttcacacctacctataattaatgatcagcactatttaaagcatttaaaggcacatttctaaactaataggcacaaataaaaatataaaattaggaagaattgaaacatttgcttagctaccacatccaacatgaaacattccttcaaaaggctttcttggaagatattggaaggagcatggagcacatacattacagagaaactgaatttgtattttgcgtaatttcaggttgcagattgctcagttctttccttatttcccacaaacacttgaagctcaccccattcttaactccatctcttggagctgattttatatttttgcaggcaaaaataagaggtaaagggataggtgaactgtggctatttaaagtaaaatatatataacacatttcctttgctctcttcttgtgataccaataccaaaacacaccatttttttttattatactttaagttttagggtacatgtgcacaacatgcaggtttgttacgtataaagagtttttcaagttccatttaaaaaagaaggaaaaacataataaagagctattattaaaattcacatcaattggcaagttaaaagcaatgctgggaatatgaccctgaagagccatttcttttttgcttctactcacttatcaatataattatagtttcattaaatgcatttgggattgaaagtgtttgtaaagtaaacatttactttaaaacaatgtattaaaagcttagaaagatgggagtatatatatctgtacacataaaagtacatctctatatatatacttatatattttattatatataatttatatgtaattatatatacttgtatatatattattagtatatatatttatatatgcaaacagtatatacatactatatataaagtatacatatataaagtttatatataaaaaagtatatatatactttatgtataaaaagtacatatactttataaaaagtatatattaaaaagtatatatatatgttttcatgatgaaagattgcaaatataaaataagacaaagaataggaaattttagtaagaatatatcaacagaaaatataattagcagcatgtcgagaacattaaattttgctgctgtcgaattttatgatagtagcagctgctctgccacttactacctaagcatcaatatcttaagacaacacagagccttattttttattattttttttctacctgaaaaaaaaccagacagggaattcagcaggtgctatttctggagaaaaatgactagcattatgaacatcttcagttatttgcctcgcttcatgtaacttcctctttcctccctccaagttctcattattcaaaaatcatttactactaaattatagaaacaatagtttctcctaaagcagaagtgaagtgaagctgggtatgagtcaataaaaaattacgaggctctcaaatcatcaaaaagatgccacctatgacatatgacctatgctggtcttggcacccgtttatgaagagactagaaggggtaatattttttcttctgtggaactgatggtccctgtcatctcaacttgagggaaggtttgtctttgaaccaaaacatattcgtttttggaggatatacacatgagcatcttttcctaagaaaatatgtccgaaacgctcatcattatctcggcaaacagagcgctgagatcagtggcttgcaagcctcagtagcctggctcattgttttcttctaggtatggtagaatcagtgagtgcatggctcagagggaggctgcagagctaggcaagcctcagttcagacttggctgctcaggaacagtgtgaccttggcaaattatggggtttcttaaagcctgtttcttcatttataagtttaagtatatgcatcatttttttaaaaaaggtttaaaagtatgtatataatactttgcacatgttatgcacagcagaagctgctgggtttccttactctttccttgcccatagaatcctgaggatatttgagtcacagagtacccagggccgggggattagtcctgactgtttttgtactatgtggcaatctcattttccattgccatggctgattttcaaatatgacattcagttatggccaatgatatgtagcggggagacctctggggcttctaggagaggtttttcaccttgaaaagacagaggggttggaggaaaagttctgtttggtgttggacttttgttatatgagaacttgaggcctggtgctgcagtagccaactgactgagacaaaactgagtatgaaaagctgagcttgagtttgaatgtgggtccccaggtcattatggagcaaccatgagacagcctcttccagccttttgttaaacacaataaatatcctgtgtttaaagcactctgggtagtatttcccattatttgtaaccaaaagcatccaacgcaaaaagtagactgttaataatatgtgttaatcagtatattttaaaagggcaaattggtatttattaaaatctatatccttgaattaatagaaaataatccccaactgaattccagctgcaattctataatactttttagaattttggaaatttaaaaatcttaaaaaaccatttttttttcgatttcaaggaagatctaataaaatttacttgaattcaatcagttatgtttattttaaaggcaaagcagaatgccatagacttatactttggaagggaatttaataataattatttatatctaaaatttaaattaacttcctgcctctaattaaagagcacttaaaaaccatctcaagagacagaactggggtttttaaatgaatttttaaaaatcaacctattaaatagcagcattttaggttaggtttatgtagtacacaggttcatgttagaatccataattatggatcacatccagtttgggtgatccatgaaaaatagctcttccttcatgcccataatttacataaaagaaggtatttcttgttccttcttttaattacatgggtaatactcactgcagaggagaatcctaatttctgttgtatttttattcctctattggagatctttctcttccctttcttctgcttatctctgacagcctacaaagctaaaggaaattaagaatgtataaacataccaatcccggaaatttgaaatcttttcggattttattagaccctgtgataccaatcagaaatttgaaacttcttttgtcttggaagctgcagacaggctgtcatattctttaaaaaaaattagtgagaaatggtacatacagatcaggtaaggacctagatctagatctgattttttttaaagtaccagcaattggccaggctcagtggctcacgcctgtaatcccagcactttgggaggctgaggcgggcagatcacgaggtcaggagattgagaccatcctgactaacacggtgaaatcctgtttctactaaaaatacaaaaaattagccgggtggtggcacgtgcctatagtcccagctaattgggaggctgaggcaggagaattgcttgaacctgggaggcggaggttgcagtgagccgagatagagccactgcactccagactccaactcaaaaaaaaaaacaaaaaagtaccagtaacccagtaactataacagtaggttgtttgagccagttcaatagagagtacaggttgttgtatattaaagtaaaatgtgtaaatgtcttctttgatgtaaaaggttacacattcatcatttgtcattaaaaaataattattgcgtctctactatgttccaggccattctacattcaaacttataaaacccctggaggccccgggccctactgcgtagtaaaaatgcctcagaagctcctgtaattcccttggccatactattgatattccaaattatattactatgtgagcataagtgtgtggctagaaaaaagcagtcaagaatgatggactgcatgcaggcaggagtgtgccttgtactcacctcagggtcggtgagctggacttgtggattatgaacttgttgcaggtggtcgacaggaactgtctgtggtttgggttgtcagggggcatcaaacaatgtaactgtgccatgtgggtgttcacgttgtgcacatgtaccctcaaacttaaagtataataataataaaattaaaaaaacaaacaaacaacaacaacaaaaaatgtaactgccccctcatcagcatgtcaaattgtattaattctcatcttatgtaaattctctgatgaacattcttatttcctgcaagattatttgagataaagctgagagttaaaatataagtaatttgaaatggatttccatgattatgaacaagaaatccttgggaacccatttctttgtccatggaccaccaaggggagtgcagagagaactgcagttccgtgcaatcaatttcctctgtaattatgcattttacagtaataaattttaaaacatgatttttgaggactcagacttccacaaactgcctgaaaggtctatgagccattgtggaagtcagtatggcaattcctcagggatctagaactagaaataccatttgacccagccatcccattactgggtatatacccaaaggactataaatcatgctgctataaagacacatgcacacgtatgtttattgcggcgctattcacaatagcaaagacttggaaccaacccaaatgtccaacaatgatagactggattaagaaaatgtggcacatatacaccatggaatactatgcagccataaaaactgatgagttcatgtcctttgtagggacatggatgaaattggaaatcatcattctcagtaaactatcgcaacaacaaaaaaccaaacacctcatattctcactcataggtgggaattgaacaatgagaacacatggacacaggaaggggaacatcacactctggggactgttgtggggtggggggaggggggaggggatagcattggcagatatacctaatgctagatgacgagttagtgggtgcagcgcaccagcatggcacatgtatacatatgtaactaacctgcacattgtgcacatgtaccctaaaacttaaagtataataataaaaaaaagaataaaataaaaaaaaaagaactagaaggggggaaaaaaagaaagtttaagagtaatgtggaaagtaaatataagcatttgtgcaacagtggtggaaggaatatggaaattagataatagaaacaagatcactaataaagtttatcactataaagtttaggtcagttttatcttcctctagcacatgaaattggggctggagctggcatcacaacatcactgaagtctctgcatggttgggaaccttcacacctcctcatgaggaagggaataagcacagcagtgtgtgattctgtggacaatcatcttggagctgttggatttagcagtggctaaaatggccatatgttttgaaaaggaagcaagtcctagagtttgttaggttgaaactggcaagcaatcacaacttttttgtctgactacattttactttcattgcttagtaaaaatataccccaaacatcggtaatgtctaagtactttcattaaatggttttatttaaaaagtgagcaagacatttcctcatatcaccatatcctgtgatatgtttttaagtttgcaaattggaaagcaggcccagagactggtatgtcttgggtggcctttcatggcccaaactagttgtaatcgcctatttccaattttctcctctctttctttatccattgcaggattaatgaagactcaggtatatggtcatattttcagaaccatgttaaccatagtcaaaggaacttgtaaatgtatacagactgtttttttaaagttatgtcacacatttgctttttattatttatttactttttgtaatttcagcctgtattttagattcagggggtacatgtgcaggtttgttacttgggtatattgcatgaggctgaggcttggtgtacgattgatcctgtcacccaggtagtaagcagagtatgcaacagttagtttctcaacacctgccctccctctccttcccacctctagtagtccccagtgtctattgttcttacttttatgtctataagtactcaatgtttagctcttacttatgagcgagaacatgtgatatttggttttctgttcctgtattaatttgcttaggataatggcttccagctgcatctatgttgctgcaaaggatatgattcattcttttatatgactgcatagtattccatataccagactattttaaaataaaggcagtttttctcttaaggagagaactgcaaataatgaaaatgtgttcaaaagttatttaaaatcaaaacaagctaagggtctttgtccattttgtgctgctataactgaatatccaagactgagatatttataaagaggagagacttatttcttagagctgggaagtccaaagttgagggcgtggcatctggtgagggctttcttgctgcatcatcccatggtggaaggtggaagggcaacagagcacgcacaacagagagggctgaactcatccttttatcaggaaactactccttcaataacagcatgaatccaggcataagggctctaccctcatgagttaattacctctaaagcgtccaacttcccaacactgttgcactggggattaagtctccaacacataaactttggtgaacacacttaaaccatagcactaagttagttatactgaatgagaacgtgctcgaagtgttactatttgcagttcaaattctattaaaaactgttgaggcataacttttagcaggctcaaaatgcctttctttttatgtttcaggttaagaatggagaaggaaacaggcttaatgtggccaaaaaccttgcatattctaatgtggccactcaaacattttttctgtctctctctggagtttaaaggcagggtaaaaatatctctgatttggaaatcagaattgatttccatttttacagatgtgcagctgaaaaccttggaacattccttggaccttctttttctcttgcacctcacatatggtttgtcagcaaatgttgtcacctttaccttcagaatatattcatactccatcacttctcactaccttctctgtgagcatccatgtcatggccaccatctctctcctgggtgactctactggtcttcaaactggtcttcctgtttccctccttgctcctgttagattcttttttcaacaccttagacagaggtctgttaaaatgttaagtcagatcatgttacccctccactcgaaaccctgtgatcattttccatcttactcagggttccagtcatggcccttccagtggccaaccaggccttacattctgttcatgttagctctcttgtctcatttcctcattttccctgctcactctacttcagccacactgacccattgctttcccttatcttcaaaccctggaatagtggctgtcacatagtaggtactcaataaattttggatagatgaatggaaaaccaagtatcttctgtgcttatactgtgatcagaaattcaaagaaaaatggactaagtcccccattttgtgtttagctcctaatgtcccttgtaagttcctgggggaccttaaatatctttttatttttctttctctattattattatttttttgagatggaatctcaccctgtcgccaggctggagtgcagtggtgtgatctcggctcactgcaacctccgcctcccgggttcaagcgattcttctgcctcagcctcctgagtagctgggactacaggcgcccgctgccactcccagctaatttttgtatttttggtagagatggggtttcaccatgttggccaggatggtctcgatctcttgaccttgtgatccaccagcctttatctcccaaagtgttgggactataggcgtgaaccaccatgcatggccttctttttagttttcaaaagccctaaatcctgatttcctctgaagtttttgtttgcattctgcattctgccttccgtgtgtgctgtcctttttctgcattatgttgctctgttgtgcatgcttgaatccttcactccccacagctctgtgtatagcaggcttggttaagatttggaataattaatgtttaggtccttgctttcttaaaagccattactttctgcactgagaacttttgatggattcatctactcaaactccagcctccttctatttccttggttttgctttttctctttcccaaagtactgcattccttcttaggacatctgattatcagagcattctttcatttctgagccagactatctcatatggtttctacgcattagcagataaaattcattttcctaattctgtaacgctcatttagaacaaataacatccctttttcagtgcttctcagtcttctggggctctacgaaagtattataagcctggataatttgactaaacatagttttcttaaaacgaaaaccattcctccatctggaaagttctatttattttggaaaaaaatatgctttatagtgattaggcctcagatataagctcattagccacattatagcctgcatttattaatacatattggctttttcaaaaaactttcttaatggatctcttgatatagtaaaaactgtgaatggttttaattgtctaatgtatattttatgacagataaaaatattattatatctgaattcatgctctattgctaaaacttaagaatgttataaataaactacttgaaatgtcccattttttggggaaaaaaactttttatgaagcttaatgtgcagttaattcagagcctacacaagaatggcctcctcttaaaagactaactattcattatgtggcattttgtagagaaatttaactaaagcaatgtaggcagcttcactccagttcttggcaataagcaacactgatgattaatgacctacactggtaattggctcttggttacagatgccatggacatttaagaaatgagactataatgaatggaaatatctcagtagttcaactagtgcttactcactgagggattaaggtgacctgacatgctagtgcaagcctggttatgtaaaactgcatatgctgtttttaggttttctttgcatggcagtaattttttttttcacttaaaaagatcttagagttaggaaaccctgccaaacagagaacattatgaaacaaatgctaccaaaaacatttgaaaccaacctgctagtcaacctaagagaagtagtttcttattttctaagcaagtgacatttcctaatgatcacctgctatgaatgggttgtattgttacattctgtcagactttagctttataaaggtctgtgcctacaggcgaacccatgggaactgggtcctggattctgcaaagaagaaccaaatcaagaatcactgtccatgaccattttaaagacctggtataggaactaagcctttcttcttgtttaaatttgccagctttgcacttggatttgccctttcagattttgatgtgtctgcacactgagatttgtcagttagtaataaactttgccaataactgaccataccatatctacccacattttttttttttttttgaaaactggttttctacaagtcttaacttttttggcttccaattggagattttagacttgggcagtttggggagtggctgtaactaagaaagcaattctcgcatgagagccagtgaaaggcttggaaatatgaacatctaggttgtttctggaagaacaggctgtatttcagcatggcatggggtctgtggatgcatacggtgcagtagactctaatgttaagctccacctgatcgtaaggggctcaaatgccactcataacagcttggcaatatcttgtagacttgaagttttcaaacaggataatgagacatgaccatcttttcgtatgtttttggaagatagctgtcttagggtgaaggacttagggagcaagaggaaaactggaacaagaactgaacatttttgttagctcatcaccaagataatgaggacttaaattagggaaggggctgtaagagggataagaagagcaagttctgtagtaggtaaggcaagacttggcatgtcacagaggtaagagagaaaacaggaagagctgaagctaactcagagttttctagcctgtgggggcagaaatgatggctttgttatgcgaggtatgcagcacatgaggaaataggttttgctgagaaaatgttgaggtttgaatatgtggaggttgaaggactgatgagacatttttctgttaattaaggtccagctagtcggcagaatttaggattgaggtcagggatgaaagacatagaattgtcagtcatctacttgtaggaaatgttttctcagtgtgagcacagtcagtccttggagggcaggtctaggttttgttcactcctgtgtttccaacctttagtggctggcacagacattacactgaatactgaatgaaataatgtgtcatatactccccaccccatttcttctttccatttttctaccaattactccaaagaaaagaaatgttaaccttaaatagttgtattattatgattttctttctaatttagaagataaacttgcagactgagaggagattggattttcaacacaatggctaagtgttcctgatctcttattttcaatctccctaatgctagctttttaaaaatacgatgattaacaacttctgcaagacattcagactttatcacaggtcttgaacaagagttaattttactgttttgttgaatgctatagcaatatattaaaattagaaagaaatattcagttatgcaatattaggaataaggttggtttcaacaaaacaggtagcctttctaaaacagagaatgtggtgaaaataacaatgttaaattacaaattaaaccagttctttgtcagtgagtaaaaacatgttcttggaattatgatttttttttaataaagctgtttgggagaaaagttcggctttatcatggttttcagtctaatcacattgtagcccaaattcactagtctgaaggttttcagtggtggtaatgagacaggtatagcaaaggtttaataacttgtgctgtgttttggctaccttatgttatttgtatattatctctttgtgttttagaaattgccaatgttccttttttctgaaaaagaatttttatgtctaaaatgagcttttaagggatttgactgaaaaataactttggaaatgataaccgattttatatgactctgattaatcgtcagccacttgtaagctccttgaagaaaggaactggatctttgtgtgtgtgttcatgtgtatgtatgtgttaggaagtttacatccaacagaggaaatttatgtaatttatacatgctgaatatggatgaggaaatgagtggtcattgaatagtgatcatctacaagatattttcagagacaaaaactacattaaactggtttcaggaaacatcataattccatcaaaagtatagcttttgaaccaatgactttcagagctgttcagaaggacgccattgttaaactgatgtgctatcttttcagtctgtgaacagcacgtggcatatccaaactggcagacaaaaggtacgaacacctattgattgctctttgttgtgtctagtgggtgaatcaaacattgagaagactctcagtgacttctccttttgcattttcttttctattccaagtcaaatatcacataacatagtagggaagcctgaaaactgacagtctctctcattgagtataaaccctgttcagtatttttctttccggaatattagccagggctgtcacattctcttctatctatgaccacctcagaatacacctctgcatgagtagggaaggtgccgtgcttgtgggagccatattcagtgaagcccagtttgcattctaaacatttcagtgcactgggatggcagatgccagcagaacgctgtcccttgtcggtctttgtcatttctcttcatccccatggctgcctctaagaaaagtataaaacctcctagactatgtctaattatgtaatcccaggtgggcaaaaactgctccctctcttcaactaatgacaagtttatgatctagggaggaagaattgatagtcctggttatttttatgctaactagtgccaagacagatgctgttttgttcttggaggtatctagagaggtctctccctcaggtgcatcatggaaacggagttggactgttttctgagtaccaatacgggaattttttctttcttctccaggccttagggtagagcagcaagattatctgttgggtcttttaaaagggaagtatccactcccttcccctgcccccttttatttagagacagtgtgtcgctctcttgcccaggctggaatgcagtggcctgatcatggctcactcctgggttcgagcaatcctcctgccttgacctcccacagcactgggattacaggcatgagccaccatgcccggctggaaatatcctcttttgaagagcataaactctgtttccgcatacttcagattagtactcctcctgtaccgtctgtgactgctgtgtctctgggctgctgctgagcttgtggctgtgtccctgcccctgtccacaccccctgcctggctcaggcctcagaatgctactctgatctccagcatggactcgatgtatttctcatgaaaactaattgaatttcgattctgaatgcctgaattctccatcagtcatttgattatagctcagcctccccataggcccataaaggagaagaagtgctgagaggatactctggctaaggactcttcctcatgacaaggcagggttttggagaaatacctctcgtgccctggcaagtgaaccttgcatgagctgggagggcccctcttgccttctcattgaagtctcaactactgatggggacagggcctctaaacgtgaggctacatggtcatatcactctgcagatgaaaaagggcatggaaagataaactcatgaaaagtcctgttaggtattgccagccaggggctccttccccgcaaaaaacagccctggcttctgtccctgcactggccacacagaggcgattcaaagctatatggaggggccaaagaggccacaagactactcactcagagcttcctatttgctttttattgtaaggttatccatcaccttttataatgccctaattgtgtctttaaagtccctctgtttttgttcactttgactactagtgagacttctcttcttccttggaggtaaaggaggtgagcagcagggggagaaaaaagcactgacttccttctggaagtcagtcatttcagccagtaccatgtatttcaatgctttcccattttgttgccaacaatagcttttgacataggcctgtcttctcctgggcatctccttctgctggagtttcatgactttggtggataagacctccagcctttccctaggctcttggctcagggtgggttctgtgtctcagagctccttgagagtggctgagggctcagggagggacatgcctgccttctgctcctacatgggggttgaaagccctggatctccaggggccggaagtgaccaccactttctttcctttctcacagcctagtttctgtgtggcaatccacagcacatctagcttgttcttgcctttgaaccctcactcgcgcagttcctgttttctggagtccttttccttatgacatttcaaatttgacttatccttcaaggcttttgtcatcttaactcctcagcacgtagggtctcttctgcaaatgtagagattattccatactgtcttatacttgtgttcagtgagacaattccatttctctattttttttttcttggctcacacttgccaaaattattctgagttatttgcaaacttctacctagaatctaagtgtcttttggggcctagctacttcctagggatctgattaaacttgatcaaaccttgcttccccagctagtgacaggccagaattctccctccagttgctgaatgtctggggtcactttctcatcactgagataaaagctgctttgtttgttctgtctttcactcttccctagagcaggggttggtaaattatgatcatttcctgctggccaaatctggcctattgcctgtctttgtatgacctgtgaactaagaatgagtttcacagaagctttactgataacacagtcaattaactcatattttgtatgtgatatgtattatatactgtaatcttacaatcagataagttagacaaaagaaaatgttattaagaaaacgtaaggaagagaaaatgtattaactattcattaagtggaagtggataattggaaaggtcttcatctttattgtttttatattgagtacggaggagaaggggctggccttgctttctcagggatagtagaggcagaagaggtggaagacatggaaggggaggcaggagaggcaggcacactcggtgtaacttttttttgaaaaaaatccatgcataagttgactcatgcagttcaaagctgtgctgttcatgggtcagctacacacgacttgccgagtgctcacactggagttattgctctttgactcttttctgactctatacatcattctttttttaccactttctacccaatcctctccctccctgcaatgtctggcaaatttattttcttatctactacagcttagtttcacctaaaacaatgtctcctggcacgtttacctccaatgaggaaatctggggccagctgttaatataattgcacttcccatctttctctacatttttaatgcaccttaaacaaaagcattgtctccttgataatctctcagcttctttactctgacttttacgatttattaaaatatttgagaaacaatatgcctgataattagaatcaacaataaaatatatatatgtcgtggtttccaagaaccctggagcatggtgtggggtgggaggtgggggatggcagggacctagaaaggtcattgaggcagtgaggtagtgattcacttaagtcccacaactggttagtatcgttagtcattcactcaagaccaggactcaggtttcctgactcacatcaaaccacactagctcctcgaatgtcctttaaattttctcctagtaaggaatgatacaagcaaataaatcaacaaacttatataatttcacatatttaactggtggggcaagatgatccaaagtaataatcatgatatgatgtcaactgtggaaagctatcaggagggaattaccaatgaagtgcctgagatggtgatagcatgcatgtgcacacaggcaggtagatgaagtgccccttccaagcttccttcttaaatagcacagcaccaaagacaattatctctactgaattgcaaaagcaataattattgtatctcctagaatactccattttttcctattttctcacctcaccgctaatttaagataactcgatggcatttcagtaggagaaaagaatttgtatgtaaatgagggaacagacaaaaacaggttattaaagtccattggattctagaaagcttcacatttgattaaaaaactatgattctacaaaagtgtttaagaacatctggagatttttttccactaaattattttgagaatagtaatgtgatttttattctagagtaaaatgaattctgcagcagctttgtaataaaagtgcagcaaagtgaaaattatctgaaaactttgcctgcctcaaccatagcattaacaccatatatattgggaagcagaggcatttctgccagttcattctctccttttagatgtgactttttgataggacgtgtatatatctgtgtctatatatgtataggtacatacatacatagcagtaagttttttattataattattaaaatgcaaaattataaacaacttcacataaatagaatattttacgatttaaaaattatgtcaacagattacatggttaacattatttatgttaatgttaagtatttgaaagtagtcaccactaatcttcaataggatgtgaggcttcttacagttttaaacacattgtagaatcaggcaacagagaccatcagttcaatgttaaagaaacagaaagcattgtttgatgccatcaactcaggcaggatttcagaggatcaatgacatcctattttttttccttaggtaggtagaagagactaggtgtgtggtaagaaactgagaaatagcttaaattgatcagatagttataagcccttgatactgtagttgcacattttgttttaggttcctaaacatctaagaatataaaataaatttatcaatatttattcggcaaaggagagagagagtgtgagaatctgtatgtgagatgaccatcacataaatcttccaacatggcatggcaaatggagagaaatgggaataaaatgtaacttctagaactactttttatcaatcagctttgacctctatttcaggacagattgtttaagtattttcttattggtggaaaaaaaaggcttctcgatttgttcacggaagctcttagactgattcctctaagggatataagagggacgctttccttgaaatcattttgctttattcaatacattgtaccaacttagtacacattttggatttctcaacttcttagacttgtatatatgatagttttctattgagtttttgacttcctatgttacagattttgtgattacaatgttaccctattctctagagattcatggttgtgaatctcaagagtagttattagctaaataagatttctaacaaaattaaagggttatggaagatgctattgataattttgtaatatcagaaaagtggtagcaaattgaacagaagttctgtgtgtgtgtgtgtgtgtgtgtgtgtgtgtgtgcgcgtgcgagctgtggacactgtgacaggcaacataatagcttccgaaagatgtccatgtgctgatttctggaatttgtaaatctgttaccttacatgcaaagggaattttgtagacatgattaagagcatcttgattatccagatgggcctagtttaattacacgtttcctttaaagtgaaagagggaagctggagggtgagagagggagatatgatgatggaaatggggatcagagtgatgtgactgctgactggtagatataaaccaagaaatgtggtcatcctctagaagctagaagagacaaggaaacagattctcccccacagcctccagaaggtgtgcagcctgcctataccttgattttagccttgtgatacccactttgggcttctgacccctccagatctgtaagataaatttgtgtggttttaaactactatgtttatggtaaatttttacagcagcaataggaacctgatatggatagataccgtctgaaagtctggtgaaacctatgagtctctttgcaggataatattttaaaatgcagaaaataaaatagagataacacacatctctatgtataaaataaaatacagagatactgaaaaggaaatcaagtagattaaaaacttttaccataacattaaacaaatttgtgatatagtaatatatgtactttgtgttaatatcttaaatgacaaggtaaatcatttaaaatatagacaagttaaatgtgatcttgtaaatatttgtcagtgtgaaggctaaccatttgttgactctgcccaattcatgtttaacaagttgtacagtcctatagaggattaagaattgaaatttgaacagtagagatttgtaaaactttgagttttcatctttttccaagtttggtcaaggaacaattgtacgtggggaacactggaaaacaaagtcattgtctgggtcaccaataagaaagtccatgatgtcactgttaactgaataactgagagggagaactacccagtagttggccagctatcttgcataagtattgttagaaaaattccatgcagtctccaaaggggtttaataactaccatgatttcaaattagagatgagtataaatattattttgatataccttgaaaaccatattgtggtatgaaaatatctatgctatttgtgacaaaatgacagataccactagtacttttttcctatatttataatttaatgaaatgctaaattttcactagagattaaaaacaaaagatggattctttttcaattcactttcatgggccctgtaaattctatccataggtcccaggttgagaacaactagaatggaagcaggacaacgagtggttttgtaaaatggagctattcttcttcctctttttcattctaattttgagaagaagggttgtcttgcttatgaacataaatcacattaaaatacacaaaacacacagagacgtgatggatctgtcttgccagcccctgatggtggagatttgattggttgtggctaagggatcaatttcctttctctcgatgtgtcttctttttcttccttaatcaaagtgtttcttttcatagggaggcaagtaattttttaaaattatttgataatgagaaaattatattctatgtcataagaaaataattaagtgggaggtcaagaatggaggttaagcagatatttagatcagatcatttgtgagattatttgtaaatatgctgtatgtactgaatgtttgtgttctaagttcattggttgaaatcctaacccccaatgtgatggtattaggaggtggggctgctgggaggtgattaggtcatgagggcaaacccttatgatgagattagtgcccttatcaaagagatcccaaagggctccctcgctctttccatcctgtgagatcacagtgagaagatggtcatctgtgattcaggaagtggtcccaccccaggtaccaaatctgctggcaccttaattttggactttttagcgttcagaactgtgataaataaatgcctattgtttaagctgcccagtcaatatcattttgttataaaaccggaatggactttataatatgtgtcatatgaaaattaagggaaatgatattatgatgtctgtattgtcattttttcaaggaaagttacagaattgatttgagcatgaatatcctgatagtgcaaaccaatcagacatgttacttaaagaaatcttgtcctgtgagggagtagatctacaacttcaattgtacaacccaacttggagagtagcgtgggtgttcttcaaacacttaggtattccctgatatcaagagtgaagtgcccattgtttataattcacagaaacaatggacctgtttccctcaatccttttaaaattgaacattactcattttttattgaaaaaacctttttttctatataaaatacggctcttatttaacttgctgtcatgaagacaaattgagctagtcaactcagtagtaaaatagacctctgttcaaatgtagtcagtaaaaagtccagctaagttggcattttgcagggtttgcattaaagcataagaaatgacaacttgctgaagagcaaaccaggcaaaacagacatccaagttcaagagaaagttgaaatctggaaggaatacctgagctttttgaaaatgacaaggaaagctgcacctggattctgctgtgaccaccatcgattccattctattacttagccatatgggacaaaggtagatctcatgaggtttttagaaagaacctaaggtatattacgacaagtgagaatacataataaatcaatagccagatgttgctggctataatggaacttgttgatccgtagcagagactttggattaattttcagtgtaaaaaatgcatcagaaacagctgactgaaacttgagaaaactgaagtgaagaatttcttatctgattaaagactgagaggcagaagcaatcttcactagagtgtgaacactgtattcagttactgattttttgctagtaatcttagatttcatatattttgatatttcttccttccctccctgaccaaccacactcatttgtagttgtgtgtatgcactgatgtatgtaggccatagaatgtgtgcaaagaggtagatttgtgcatatgaattgtaaattaaccagagctacagagtagacagatcggtaagtttatcaggcttttatagtcacctactagagtccttgatgaaggttatggagctaaacatggagttaagagacatatctcaggcagaatccttatttaaacatgtaaaactacaagtccaaatatcccttgatatttgaaaacactattaatgtctattatcatagtgaccccaatggttataaggacttgtgaattcaccagttatgtacaagcgccctggctattgcacacttcacactgcaaactaccctgttaggtgtgggatttagacatgatgccagtagatggaggcatcatgtaggaccaggggttgggaggtaaagtatgtgcgatcaggcaccagagaaaggaggagaaagaggctgggatttctgtggcacactaatttggtgacatggtttggatatttgtcccctccaaatctcctgttgaaatttcattctcaatgttggaggtggggcttggtgggaagtgtttgggttatgggggtggatctctcataaatggcttgctcccctgtagtgatgagtgagttttcactccattagttcacccaagagctggttgttagaaagagtctggcaccttctgtcctccttactccctccctcaccttttgacatgccagctcccattgccttctgctatgagcaaaagcttcctgaggccccaccagaagcagatgctggctccatgcttcttgtaagcctacagaaacaagagctttatttatttatttttttttttgcagatgaagagaaatataactttttatttttctcatacaactacatttttttaaacatattaaaagtcttctagaacttccacagtgcacaaatagggcattgaggggttttgttgttgttgtttttttgagacggagtcttgctctatctcctaggccttgaggtattttatttttatttattttttattttattttattttattttattttattttattttattttattttattttattttattttacttttattataccttaagttttagggtacatgtgcacattgtgcaggttagttacatatgtatacatgtgccatgctggtgcgctgcacccactaactcgtcatctagcattaggtatatcttccaatgctatccctcccccctcctcccaccccacaacagtccccagagtgtgatattccccttcctgtgtccatgtgatctcattgttcaattcccacctatgagtcagaatatgcagtgtttggttttttgtttttgcgatagtttactgagaatgatgatttccagtttcatccatgtccctacaaaggacatgaactcatcactttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagttctttgggtatatacccagtaatgggatggctgggtcaaatggtatttccagttctagatccctgaggaatcgccacactgacttccacaatggttgaactagtttacagtcccaccaacagtgtacaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgttttttggctgcataaatgtctttttttgagaagtgtctgttcgtgtcctttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttattgccattgcttttggtgttttggacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaacagtaccatgctattttggttactgtagccttgtagtatagtttgaagtcaggtagtgtgatgcctccagctttgttcctttggcttaggattgacttggcgatgcgggctcttttttggttccatacgaactttaaagtagttttttccaattctgtgaagaaagtcattggtagcttgatggggatggcattgaatctgtaaattaccttggacagtatggccattttcatgatattgattcttcctacccatgagcatggaatgttcttccatttgtttgtattctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgagggcaattaggcaggagaaggaaataaagggtattcaattaggaaaagaggaagtcaaattgtccctgtttgcagatgacatgattgtatatctagaaaaccccattgtctcagcccaaaatctccttaagctgataaacaacttcagcaaagtctcaggatacaaaatcaatgtacaaaaatgacaagcattcttatacaccaagagctttaaataagcctcttttctttgtaaattactcagcctctggtattcctttgtagtaaagcaaacaatctaatacacttggttaaagaaagaggaaagcagtgattttcattttgatgcagcactttggccaggcagtgttagcatgagtacatcagctggttatgtcaagatgtgtagctgggttgcttttgctgttttctagactttccagtctttttttctttccttttgaaagaggaactgaatctttaattctgtttttttttttttcagtcttgttgcttaaccatttaatacacagcaggtcatctggcacatgtactattctaagctttatggataccatgatggatacatcagcatcctcaaggagtctgaagttgaagttggagatgtaaatagatcattccttcttgcttaatacgagactggctggaggccttcattttaaagaaagaaactaacatttgctgaattttgactgtgtccaagcactatgctaggggccttaacattcattatataccacataatccttgaaaaaattcagtggtgtggaagagtcccacagcatatctaccagcagccaccaactctcaatagctttttaggcaacttaaggctgaattcactgctttctaaatggatcttggtcaagctacttaactttcctgaaaatcagtgtccccaaaagattaaattggttgtaattaataatatctacttccaggatgagaatcaaatgaaataaaataatttacaatactaaaatattgagcgtactatcataattcaatgaatgtttcctcttctacattctttccattttacattaaaatgaaaggaattgtcattctttcacacatggcttctcaaggatagagctcctataacatatgtatcactggcaacactgaaaagaatccagcggaaataaaagctgatgatcaatggccgggtcttgccttcaaccctatcagtgctagctccagggacatacaactcctgctatattgggcatgaaatgatttaactgttatgttctgggctgctgttagcagagggatgttgaatggtcttacatgggtagtgtcatggctttgtggaaacagagagttccttttcagctactttctttaaaaaatttaattttcctcatcccttccatttttgacagcagaagaatgctgcagccatgtgaaagcattctagacctaaagggaaaataatctcccagaatgttcagaggaggtttctgattggctcagaaccaaccccttagaccttcaaggaggaagaatcactatcaggccacatgaagtattagaatttattgcctatcagtatgggtagtaaaatttattttgaaaaggatatataaacacttttagaaaatagtacatatctatggttaaaaaattgtgctatagatttaacttgcttaagactgttgctgcccttgccaaatgcacttttatttgttacgttagatctttaaaatgaccttggtagctgtaaattatatgctttgtattgtttcaacacaaattgatttcaactttcaagttgaaatggcatcctttaatgctcatgttgtaagcgggaatattatctctctcatccttctttgtacctcttttctatctcctctgtctcatggttctgtcatcagtacctttgcttttcgttgttaagttcagccttgaatgtaaaaagggagaatgtgaggccatctggcaaataagtcaggaacaaaggtttaaagaaaagtgaggttaaacagtgtaattcctctggtgtttacttctctgattatctacctcaggattctgaaatttggttgtgcaagaggattacctggagtgtttcttcaataggtagtttcctgcatccaagccctagaaagtctcattctgtctgtttgaggtgcgcatagagtgcttaatattgactaagcactgcagacggtggtgatgcagatggtcctcagagcatgctgcaggaaatatttaatctcgtttcccttggtgatggagaataacactccttttggccccaaatggcagaagatgccatttcaaatgttagctgtgtgcctcctaagtctagtgaaatggccagcttatcctgagaactctggagttggtggaaagaattggaatccaatagctggcatctagaagataaatttgtagtattggatacatttacccatcatgcacaagtttatatcttggattaataggatgcaccgagtcatcaggcaccctggaggagatctttcagtgaaaaccagccgcttttggaagggtttcagttagtctttgtagaggtaactggagctacttcccaggaagacccctatcctgatagatttactgaactctgcaaaatacatcaaggatattttcccttgaccagaagagataatggagctagcacatggcattccaattatgtacttccaatacgtcagaagagatgccactggaactgtcccttactattgatgccatggctgaaagcttagatgcccatcgatctttatttttgtatagttaagggacacattatagggaacctcacttaaaaaattatttcaggtttaggggtacatgtgaaggttggttacatggttaaacttgtgtcacgggggtttgttgtgcagattattacatcacccagatattaagctcagtacctaatgctatcttttctgttcctctccctcccccaaacctcacccctcaagtagacctcagtgtctgttgtttccttctttgtggaacctaacttcttttccagttagcctcagggacaagttacaggatctaacagatttattcctgcagcgccacctacaggagaatgtatcagtgagggttcgatcaggaaaacagagtcactatgaatgctgtgaatgaaggcgtcttacctgattgcgaagatgttgggtaagtgaaggcccagtagagggcgctggaggatcagagaaagagcaccaaccagccttcctgaagcactgagatgggggataagtcagttttcagggaaatcagagaagctaggtatacatctgaggactccaaaggcaggaggccctggctctgatgcttctaaggcagatgaattgggtgccagtggtgggggcgagcatgcattggagtgttccttgtgggccagaggtgagccccaaaggagagagctgttctggggccattcaaattctgtccaagaggtctctgcaagagagctggaaggaccacacatgagcagcctgtctgagaaaaatctgttgctgctgtctaggtaagcctccttggttgttctctggcgagactgaagcgcccacacaagccatccaaggaaaggagtcggttttggtcatccctcccagcgagaggtggctggagacatctgcaaatgccaggaaaaacccgctccagattgtactgggtctgaccttgactttttttcctttatcttctccacgcctggagggacccatggcagagctagaaaatcatctgggagaagaggcagtgaggtggggaaacagaagagaagctgaaatataccctattacaaccttctgagcttgtctaacctaggagaggcgaggtgctttcacgttaggtaaaattcacgctttgaaaaacattggactaagttgtatgtatttgttactattcttacgattgaaggtaaacaggtttttgagtattgagtagtgattgaagaagttatggactttatcagagaattcatacagtggcagggaaagaactggcgcacagagtgagtttaaagagcagtgggacaaagaataaagttagtttctgattaagtcacatggtcatgaatgttcagcttagcagtgacttgccatggtaaaaatgtcaggcaacccatagtagtttcatccagcttattttgactccagtttatttatttacttgaaagacaagtagaagaaaagagtttctgaatatttggaagattttgccgaagtaagtaaatgcagttgcatgtagttgaagagcatcagataagacaaaactgagccttgttgcagaagaaaatcttgctcagtggcactggagctgctgccacgtcttcactgacttatccctagtttttagaagctgctgttaacttcctttgatggtctttggtcagtagctaagcctataatatgagcctttagctgcttgggaatttcagtcttattttgctatcttcatccttttacaacttgtaaaatctatgcaattgagttgaaatttttgatttctactcaagaatgcagaagatgaaatgaagaggtaatgtcatatatctaaattatctaaattccaatctccttttgcctgaatttgtaaactcctatatgcttgtgaaccccttagtatagaggtggaaattatatggcttattcataacaggataaaaatcttagacataaaattagaaataaaataaactggaatatgaacttgaaatagtcctaatctctatcctttttcccttggaaaaaccctaattctttttttctaaacttaaccctaaccataatcctctaaataatataggaacaatttgattattgattttgtgactataaacgtttttattaagcttcacgttttcgaatataaagaaattgtgaaaatgaagcattttgctgaaccaaaattgcattgttagttcttgcaagcatgggtttcttttcttgtactaagtaaaatttcttaaagtgtaaatcaaaagctagtacctaaagaaaattctggctttcctgctggttcacccttgcttagtgtcctatgcagggatgggatgggtaccctcagggcaaaagtactggttaagcttcttatggtatctacagcatgcaggtctgcccttgagcccaatggagaaatttactaggatgccatctgagagtgtgaacccaaattgccctatttcagaccttttaaaatgccccttcgaaagaagtgtctattagaaaaagccaccttgggacagtaattgacatctcatcctcagtatgctttcagtgttgtccttgagtcggatttgatggctgaaaagcaatgtacctggttattagctttgccctttgtagctaccctccctgagctgcagcataatgggatgttcccagtttttatggaggtcgcaacaagaaagaggcatatgaaatttgctccttcatttactctgacaccctctattacgttatttaatgtactttgtataaatcctcacatgagccattcctttagagtttggttacaggtaaaaaacttgtctctcctaaggaatttgttgctaagcttctttctcttaggttataagaactcagtattatttacacacttacattttatttctatggttctgaaatactattgcaatttataaacctttttaagccatagtttacatgttgttccaaattatttttgggaaggggtaaaaattaattaaacaaaccaataatattctgtgattgtcctagtttagtagccttaaaatattacttttagaaaaactacctttaaaagatgttctaactgccaagttatttaaaagtataacataaaaatatccttattttaacatgggaaataacattatgtattttatggcactattgtggtgatcacctcctcacctaaaaagaatggttgaatattcttcaatttatttaccattcatgcagtacataacaatatgtctcactcaaagggtgtgtttattttccctatttattgcacttttgttgttatcatatataattgtatcaaaagtcaagccttcattatacaataagtacatgtatacatgtattcacagtaaaaatcaagtgatggatttactgatttttaaaagcatatccccaattcattcgttttttagactctttttgcccatttcaaagaagcaataaacagtatctagtctttgttgtttttctgatataatattttcttcttttcataatcagctgcacttttgtaacctcttagaaagcaataattactttggtctgtccttttattgctgtaatactctacttttctcttaaaaaatttcaaagagcatagaaatcagtgctctaaatgagtgaaacacatgtaaacaccttagataccatagtatctatggcaactgttttttggataaggtaatttaagtaacaatatgtttgtgaaatattagaatgaaaacttccataaatttgtcttttataaaaataataattgttatttttcatatctgttgatgaaatacatactttcagggaaaatttattgaaaggttaatttcattattaaaaaacttggaaccatttgggtttaatatctgcttcatggaagtacctggactggtatattagtgaatttcttttttaaatttgaatttttttttattatactttaagttttagggtacatgtgcacaatgtgcaggtttgttacatatgtatacatgtgccatgttggtgtgctgcacccattaactcgtcgtttaacattaggtatatctcctaatgctattcctccccactgcccccaacccacaacaggccccgccggtgtgtgatgttccccttcctgtgaccatgtgttctcattgttcaattcccacctttgagtgagaacatgtggtgtttggttttttgtccttgcgatagtttgctgagaatgatggtttccggcttcatccatgtccctacaaaggacataaactcatccttttttatggctgcatagtattccatggtgtatatgtgccacattttcttaatccagtctatcactgatggatatttgggttggttccaagtctttgctattgtgaacagtgctgcaataaacatacatgtgcatgtgtctttatagcagcatgatttataatcctttgggtatatacccagtaatgggatggctgggtcaaatggtatttctagttctagatccctgaggaattgccacactgacttccacaatggttgaactagtttacggccccaccaacagtgtaaaagtgttcctatttctccacatcctctccagcacctgttgtttcctgactttttaatgatcgccattctaactggtgtgagatggtatctcattgtggttttggtttgcatttctctgatggccaatgatgatgagcattttttcatctgtcttttggctgcataaatgtcttcttttgagaagtgtctgttcatatcctttgcctgctttttgatggggttgtttgtttttttcttgtaaatttgtttgagttcattgtagattctggatattagccctttgtcagatgagtaggttgcaaaaattttctcccattctgtaggttgcctgttcactctgatggtagtttcttttgctgtgcagaagctctttagtttaattagatcccatttgtcaattttgtcttttgttgccattgcttttggtgttttagacatgaagtgcttgcccatgcctatgtcctgaatggtaatgcctaggttttcttctagggtttttatggttttaggtttaccatttaagtctttaatccatcttgaattaatttttgtataaggtgtaaggaagggatccagtttcagctttctacatatggctagccagttttcccagcaccatttattaaatagggaatcctttccccattgcttgtttttgtcaggtttatcaaagatcagatagttgtagatatgtggcattatttctgagggctctgttctgttccattgatctatatctctgttttggtaccagtaccatgctgttttggttactgtaaccttgtagtatagtttgaagtcaggtagcgagatccctctagctttgttcttttggcttaggattgacttggaaatgcggggtgttttttggttccatatgaattttaaagtagttttttccaattctgtgaagaaagtcattggtagcttgatggggatggcattgaatctataaattaccttgggcagtatggccattttcatgatattgattcttcctacccatgagcatggaatgttcttccatttgtttgtattctcttttatttccttgagcagtggtttgtagttctccttgaagaggtccttcacatcccttgtaagttggattcctaggtattttattctctttgaatcagttgtgaatgggagttcactcatgatttggctctctgtttgtctggtatttgtgtataagaatgcttgtgatttttgcacattgattttatgtcctgagactttactgaggttgcttatcagcttgaggagattttgggctgagacgatggggttttctagatatccaatcatgtcatctgcaaacagggacaatttgacttcctcatttcctaattgaatactctttatttccttctcctgcctcattgccctggccagaactttcaacactatgttgaataggagtggtgagagagggcatccctgtcttgtgccagttttcaaagggaatgctcccagtttttacccattcaatatgatattggctgtggatttgtcataaatagctcttattattttgagatacgtcccaccaatacctaatttattgagagtttttagcatgaaggtttgttgaattttgtcaaaggccttttctgcatgtattgagataatcatgtggtttttgtctttggttctgtttatatgctggattatgtttattgatttgcatatgttgaaccagccttgcatctcagggatgaagcccacttgatcgtggtggataagctttttgatgtgctgctggattcggtttgctagtattttattgaggatttttgcattgatgttcatcagggatattggtctaaaattctctttttttgttgtgcctctgccaggctttggtatcaggatgatgctggcctcataaagtgagttagggaggattccctctttttctattgattggaatagtttcagaaggaatggtaccagctcctccttgtacctctgatagaatttggctgtgaatccatctggtctggactttttttggttggtaagctattaattattgcctcaatttcagagcctgttattggtctattcagagattcaacttcttcctggtttagtcttgggagggtgtatgtgtcgaggaatttatccatttcttctagattttctagtttatttgtgtagaggtgtttgtagtattctctgatggtagtttgtatttctgtgggattggtggtgatatcccctttatcattttttattgtgtctatttaattcttctctcttttcttctttattagttttgctagcggtctaccaattttgttgatcttttcaaaaaaccagctcctggattcattaattttttgaacggttttttgtgtctctatttccttcagttctgctctgatctcagttatttcttgccttctgctaccttttgattgtgtttgctcttgtttctctagttcttttaattgtgatgttagggtgtcaattttagatctttcctgctttctcttgtgggcatttagtgctataaatttccctctactgctataaatttccgtctacacactgctttgaatgtgtcccagagattctggtatgttgtgtctttgttctcgttggtttcaaagaaaatctttatttctgccttcatttcgttatgtacccagtagtcattcaggagcaggttattcagtttccatgtagttgagcagttttgagtgagtgtcttaatcctgagttctagtttgattgcactgtgatctgagagacagtttgttataatttctgttcttttacatttgctgaggagtgctttacttccaactatgtggtcaattttttaataggtatggtgtggtgctgaaaagaatgtacattctgttgacttggggtggagagttctgtagatgtctattaggtctgcttggtgcagagctgagttcaattcctgcatatccttgttaactttctgtcttgttgatctgtctaatgttgacagtggggtgttaaagtctcccattattattgtgtgggagtctaagtctctttgtaggtctctaaggacttgctttatgaatctgggtgctcctgtattgggtgcatatatatttaggatagttagctcttcttgttgaattgatccctttaccattatgtaatagccttctttgtcttttttgatctttgttggtttaaagtctgttttatcagagactgggattgcaacccctgcctttttttgttttccatttgcttggtagatcttcctccatccctttattttgagcctgtgtgtgtctctgcacgtgagatgggtttcctgaatacagcacactgatgggtcttgactctttatccaatttgccagtctgtgtcttttaattggagcatttagcccatttacatttaaggttaatattgttatatgtgaatttgatcctgtcattatgatgttagctggttattttgctcgttagttgatgtagtttcttcctagcctcgatggtctttacaatttggcatgtttttgcagtggctggtaccggttgttcctttccatgtttagtgcttccttcaggagctcttttagtgcaggcctgatggtgacaaaaatttctcagcatttgcttgtctgtaaaggattttatttctccttcagttatgaagcttagtttggctggatatgaaattctgggttgaaaattcttttctttaagaatgttgaatattggcccccactctcttttggcttgtagagtttctgcctagatatcagctgttagtctgatgggcttccctttgtgggtaaccctctctggctgccctaaatattttttccttcatttcaactttggtgaatttgacaattatatgtcttggagttgatcttctcgaggagtatctttgtggcgttgtctgtatttcctgaatttgaatgttggcctgccttgctagattggggaagttctcctggataatatcctgcagagtgttttctaacttggttccattctccctgtcactttcaggtacaccaatcagacatagatttggtcttttcacatagtgccatatttcttggaggctttgttcatttctttttattcttttttctctaagcttctcttctcacttcatttcattcatttgatcttccatcactgataccctttcttccaagctgattccagttgatcgaatcagctactgaggcttgtgcatttgtcacgtagttctcgtgccatggttttcagctccatcaggtcttttaaggacttctctgcattggttattctagttagccattcgtctaatcttttttcgaggtttttaacttctttgccatgggtttgaacttcctcctttagcttggagtagtttgatcgtctgaagccttcttctctcaagtcatcaaagtcattctctgtccagcttttttccgttgctggtgaggagctgcgttcctttggaggaggagaggcactctgaattttagaattttcagtttttctgctctgttttttccccatctttgtggttttatctacctttggtctttgatgatggtgacgtacagatggggttttggtgtggatgtcctttctgtttgttagttttccttctaacagtcaggaccctcggctgcaggtctgttggagtttgctggaggtccaccccagaccctgtttgcctgggtctcagtagcggaggctgcagaacagcggatattggtgaacagcaaatgttgctgcctgatcgttcctctggaagttttgtctcagaggagtacctggccgtgtgaggtgtcagtctgcccctacttgggggtgcctcctagttatggtacttgggggtcagggacccacttgaggagacagtctctctgttctcagatcttaagctgtgtgctgggagaaccactactctcttcaaagctgtcagacagggacatttaagtctgcagaggtttctgctgccttttgtttggctatgccttgcccacagaggtggagtctacagttgcaggcaggcctccttgacctgcagtgggctccacccagttcaagcttcccagccgctttgtttacctattcaagcctgggtaatggtgggcgcccctcccctagcctcgctgccaccttgcagtttgatctcagactgctgtgctagcaatgagcgaggctccgtgggcataggaccctccaagtcatgtgcaggatataatctcctggtgtgccgtttgctaagaccattggaaaagcacagtattagggtgggagtgacccaattttccaggtgccgtctgtcacccctttccttggctaggaaagggaattccctgaccccttgcacttcctgggtgaggcgatgcttcaccctgcttcggctcacgcttggtgcactgcacccactgtcctgcacccagtgtccctcaatccccagtgtgatgaacccagtacctcagttggaaatgcagaaatcacctgtcttctgtgtcgctcacgctgggagctgcagactggagctgttcctattcggccatcttatattagtgaatttttaaactcatacttccgtaagttaaaattgcttcagtcttctgctttctcatgaattttttggagttcctagaagcttaatgactccatgtatcaatgagtcaaaacaagttatattgattattatacctactgtgtgtaggacccaaccaccaggctcatgcaatattcaagctatcaccacatacaatcattggtcatagcaatcatgaaaacagtgagaaaacagtgaatagtttccttcctgcctctctttcaatctttcttcactcctttcctgcaaaatgaaagcctctgaatgagcttgttatttttggtacctcacatatatacagagtaaatgggaatctttcagtctccatgtccagctaagttactgtttactttttctatttctagctctcctaggaaatgtgtgtcaagattcatacaattaacccagaaggaagcaatttatttctgtgaattattatttagctgtatgatcttttcttatccctctaccatggccaagttgaaatttaaattctgtattcctaaaataattaataatccagaaaggagctgttttttttttctatttaaacaccaactctagcaaaccagaataaagtgtcctgcaatttagatacagtttggaaatatttgcagtgctgagacttgattacagagttggtagcagggatggttaaagattgaccatcttgcgttctgctttgggcaaatcttaggaaaggaccaaagtgcttaaattcagagtacaaatttattcactaaactaatatttattttgctctactaagtgctaggcttttatttttttcaaattttgctactgaggatagataataaattcttgtcccatggatgtaacaacaacgacaacaacaaaaatctagatttgttattattattgaagccatcagctacaatatatatttgattattttaacacgcagatatcaaattgccaaacaaccctttatctaatggcttggatgaaccctaatttttaagaagaaataaaacagatatttatttttttgactttcaattaggtgggtagaaaaataaatttgtataattgttttttacttatttaggttctatgataaatggctatttttttacatagttgatatgtatctttataatgtataatttaaaaagaagtttcattatattcactttattctactctgtagagctaaaagtaagcaaaggggatctacttaaaaatgttatgttaaatatagtgaactccaagtttctcttcaaagaatcagtatgtcagtatattcagctctcttattctctgttctctattttaaagtttaacttcctggttctcttcaccctcttgcttctagtttcagtaaacaaccccctcctagcctctatcacctgctccatcctgagtcgcccctggtcacttgctctgacttcagttatcctgagtcacctgttctgtaactattgttcccaccaaactactcaccctgccactctgacttgtacccatgctctctttaaaatagccagtcggaattagcttagactgtgtggtccaaccctagccaataggggaacgacacagcagtgggggctacctgctttagggataagaaccccttcccctcccatgttcaggtgcgctttcaccatttctccattcacgagttgtacccttctatagaagtaaaaattgccttgttgagaaaattaaatttatgttcgagtgctatttctttgtggcaccgaaaatttatttataacagttattagctttttcaatattttttagaggttgtgagaattgaggaggtggagtcttagagcattccaatatttgtaaaacaaacaaaaagaactaaacccacctccccatctcgcacacccctaacctgtgaaattacatttgtaagcaaggcacttcatagtagatggctccgtttcctagagagaaagtttcctatccgtctagagcagttttattgtccttatttcatgtttccataaatcacactactctttgttccttctttgtcacaattttccccaaaatggtaaaagttaagaaagatgaaactttttaggctgcttgccatgcttttgcatgattaattcacacatgaagaaaacaaaatacctttaatttttaattaaagaatttacaaaaggagaaaagtgtttattgagtgataaataataatgattgattaaaggaatgtgtaaccagctctatgagctattgaaatatcctgccaaagagaaaatgggaagaattctgttttgtcagaattccatttaaagtaatagatattgggaaggggaaccaggagatttccaggtaatagtaaggcttttaggtgagtgaggtcactggctgagggagccctcattcagaatgggcagaattattcaagtttcatgatgcccaagagtggatgtgggcagccagagagctgatctgtggttttttgaaacagagttcccagggccgtgttatctttctgtggtcttgttaaacattttcatctcaattccccaggaatgtgttttcttacgggaaacatattctgactttaaaatgtaattcatttttgatactagaattcaattcattcaaatttagagtcacctttgttggaaaaatcttaacaaaattttatttaaattacctttattacacaaagccacgtaaagtgtatttggtttcatgtatgagtgtgtttatgaaatgaggtgttggacataagtcaatttcagagacttgaatcgatacagcctttagtacacttttgtgtagttcgttttagtttctcgcatattttctcatacttaaaaattctcatgagtttaaaggaatgttggtactattcaggctactaaagcttggctcatgaatctcaggaagtgttcaatactttatagtcaggaaaaatagattttgtatcttgacctttacattaagcttttcttttcagaactatattaccttgcaaagtacacagggaactggagccagcttgtgaccttttgttaacatgtagttttgagaaatgggaaaaaggcatttttattatcaggaattttattacctaaaagagttaggagtcagttgaaagacctgcctttcttaaaaagacagctagccatataactttgggacagatactctcttttggagaatgctgcaatgcctgcagtgccatcccaaggccattatgtgaagtgggaagcaaatagattacggaaggtgaagatgctaagagaggcgaggaaatacttgtcatgttgctgtcaggaacatacatgaacttgtttttattagttaaaatcagcttaattaatatataggggactctagtgttaattgaaaattcccctagtggattagaagggtaagggtgattgggtagggaggttaacttgttcatttgtgtattttctgtttctttccctggaatatatatatacagggctttgtttgtttgtttttttcagtgttgtttccttagcacattgcagaaagtcggtaatcagtatctggataaataaatgaatgctaaaactagccaactaatttcattttaaattaagacttttcaggaatcactatgtttacttattactcgctaagagcttgaaagactgttctaggaaggtagattttatagactcagggagtgggttgggactcaggaacaattaaatcagcagactgtgaactgttagcatgctttctacagtcacgaggaagaagcaagagccttgcaaggaatgatgggatagcgcctttattgtgggacaaactaattgcttaatgaatagccaataacatttcctcatactctggtttctctttggatcttataaaccctttgtcttttaccaaaaaaaaaaaaaaaaaaaaatcaaaaccaaaaccaaaaaacaaaaacatttccttatgtaaagggacatgacttttaaaaaatatgaatatttccacttttcttgtggttctccctcctgtccttctgtcttttcaaccagttgtcaatccttgcctcagaagagtttatgattctacagaacagcaaagaaaagcttttgggtttcaaaggtattgacttttatgttgtaaaaatctcaggtccaaagggaaagttgatgatataagagtaaggttcctgtttgcatccttttctcccactgcagggttggggaaaagaagccctctgcacaccagaattacccagagacatggaacacttagcactgcatcatatgttggccttacagaggtcctccgtattccaatgtgaggaaggaagtggtggtacatttgcagaaggcactaaattaagcgactctaatgaaccagatagaagggaccactgcaacaggatttagtttcctcctcgaaccatgaaagagaccaggagagaataggccttcctctttggcagccaacatggaaacaggatgaacaagaccaggaggaggttttcctctgtttcacaggtattccatagtcactggaaactcatatgcatcctggaaagcagtaatattgactttccaccacaaagtcaaagtttgcaacagaagctaagttgttataaaagaaaataattgctttaatatacggactgaaatttgcacccaatgcatttagattttgaatgttactgttcaaaaagccaagtctgaagccaaatgtttttttctttctcttttaatgttgatttgctttttctgcctggatgcttcaacaattctaacttcatctttaaaatttagtaacttaatgagaatatacctggcttgcttattctgcaacagctttcatattagaagatatattttaaaatttttatttagttttattcaaaatttaaagaaatacttttgtattctttctccatataccttttctttcctatttttcaatgattgatagatgtcatttatctgctatttatattcaccaatttcttttcattagctttgagctttttgtctttttctctctgcatttatacatgttttaagacattttccatgctgtaatttcaatttttaacttgttttcttctgtttctaatttatgtattaggtctataataatagaatcttttgtttctcattttttcccctttagcacttcagtttccctaatttgttttatcatcttgtctttgagttcttttattgaattcattttcttctaaattcttttatactgtgaagtacttgtgggaaataagttctgttctttgggttatgtcttcttgatgatggattcttcatatgttattcactagctaatttttttttcaactgtagtctgttgccattgtttccgtggcatgcattttcattcggttattggttaacagagtgctttgtctggaagtttctgttatgacatagtatgggtaaattctctttgctatagttcctttgttttggagagttgtttgattgttaatttaggtgctacattttgacggcttggttgtctgttctatcggcttttctgaagcctgagggttcaaggattaaagaattataacccttgttctggacaatttgggtttggctttctcactgaaatcctacaaatgtctcctactagggactacctatttccattaatattatctattttctccatctgaaggtggtaagttccagtatctgtttttgtctttctgagatcctccaggggtgcgatcctccaggatcctccagatcctccgggacctctagtatcgaatatcttcctgtgtctttctactcagctctcagtcaccctctctctaagttggaggacattagcagcattcttagaatttcttcaacctactctttttctttagtaaggtttttggagaatgagaatctgttgggtgtcttgttggattccatggtatttatttatcatacctattgtgaatattcacagcacttgctataacattttgatgtatttgattatgtagcaccacccctaacatgccaaatgtaatgcaaagtttatacatacattttaaaatacgaacaaatctgaatttctgacttatgttctgtttccattgcttgacatttacagcatgaagctacttcccttcccttgtttgcttgctgctggtaaatttgaggccatttactttttctttatttaaaaaaaaaatcttaacccgaaagactgagctatgacttcatattaagctttatagtacaaggcaaaaaaatgaattcaaaatagagagttatgtaaaaccaagtgtattcattcaatgagagttcatttttaactctcttgccattatttactgggaacataaatctattgtattttaacttaaaaatgtaattgtgctctagattccaattatctttcttttctcagcattgttatcaaacaagtcttaaaatgggaatttcagtgctttttgaatgaattaatgtattttaaaattttcctatattttacataaacaccgttttggaatgtgacttttgataaaaatattcctcctcagtgaaatgaaccatccctgcaactcttacagcaaatatatatagttatgctagttttatctcttccctgatgggaaagcacacaattatctataagatatttcagcctgtaactgtgttttatccttctttgaagaacccccccccaacacatgtctgtgtgcacacccaaaacagctttaatattactataataatatagcaaaatgtttgacgctgggtgctataaactttaataaatgcaatgcagtttgagaatcttaacaaatttctaagtggactcttaaaaaacagactctcaatacctaaatcaggattactaaaatgattgctgaaatgaagtgttttatatttctattgagaaagaaatataaaatacaatattattattatatgagaagtttgaaagaaaatattcattatctcaatgtttttggaccaaaaaaaaaaaatcttagtaaaagtaacgtaaatacaaaaaagtcttcattttgcttaacatataaacattttcaaggaaattaaacatatctggtagtttttaagaaaattaaaactagaaaatttgatccaaattgcatgttcttttcaggagcacggactattctctcatgttgaatgtggcactttttacatacaagcaggagagcaactacaccaagattttggaaaacatgttatgtaaggtaagatactactatttctagtttagaaaactggaaatcattttctatgaagaaaaagtaagacttccagtatttaaaaaattgactaaatatggccaggcatggtggctcacccctgtgatcccagcactttggaaggccgaggcaggtgcatcacttgaggccaggagttcgaaaccagcctgggcaacatggcaaaaccccgtcttactaaaaatgcaaaaaattatccagatgtggtagtgtgtgcctgtagtcccagcggcttgggaggctgaggcacaaaaattgcttgaaccccgggggggtggaggttgcagtgagccaagatcatgccactgcactccagcctgggtgacaggtgaccaaaaaaaaaaaaatttgactgcctttaataactatggcaattactgaaatttattaaaatatttactatcatcaaacatgtgctactgttgttaatcatatgtattcttttgttaaatacagacattgtaataataccccagacaatagcaaaatgctaactattctttacttgtttacctattcacctaaataagagcaaatttactagtcttctattttacttatgggaaaaaaacccattatttccttaaatgaagtaaatcatcaattaaatcaataaaagaactgatagtctataatcttagatcccagaatttttccctagatacttttagttctactgggaactatagtacaataatatttgaatattattaaattatattacttataaaattatcagcttcaaggtgtagatttttattgatctgatttttattagcttaggtaatagttttctgtcttgtttttaatctttcttaagccaaattttatccctaaattagaaatgtcctagaaaggagtctctcatgctgaacagctttctacttttcaagaggacagctaccctttctttactttctgcccacttgtgctagtatctgctcattgtgggagaaacacacagtcacgctgtgtttaaagtcatgctcatggccaggcacagtggctcatgcctgtaatctcaacattttgggaggccaaggcaagaggatctcttgagcccaggagtttgagaccagcctgggcaacacagtgagatcctatctctaaaaaaaaattataaaaataaaaaaaagaaaaaggaaaaataaataaagtcatgatcactaatctcaagtgggcccttagtgctgttggcaattatactatttttccctagtactttaattcttctgctctgtcctagataactgtttcattccttttcttttcttttttttcttttctttcttttttttttttttttgttttgttttgagacagagccttgctctgtcacccaggctggagagcagtggcatgatctcagctcactgcaacctccgcctcccaggtttaagcgattctcatgcctcagcctcccaagtagctgggattacaggcatgtatcaccatgcccggctaatttctatattttttagtagagacagagtttcactatgttgcccaggctggtcttgaactcctgacctgaagtgatttgcccgactcggcctcccaaagtgctgggattacaggcgtgagccaccatgcccggcctcatgcattttctattttcaaaactctaacatgttctttccctttctcattttcagtttttatttttaaaatcaggagagaatttctgcaacatcctatgaccacagatccctacccatctgcattggggcacttacagatcaccttctcttctgaactttgtatgaagtgaccatgtccctcctatccctttccatgtgcacaagatcatgtcatctctagcttattcaaagacattgccttagcaatctgcccttgccttctgtttcatcagtttctaagcaacaactagaaaggccaaagccttacaggaccagtctggccaaggcatagctacagcatctttctcatctgtctagcagacagtttctattagatcattcccacaagtacatacaagcagacttacatttctcacctcacactttataaaaaacaaacaactccccaggcacccacttctcctctccaggtacagcccctttgttatcctttcctctacaactaaacttcttaagagaaatttctatactagctgtttcctagttcttcctcattttctcttgtgacttcactccagtcaatccaagataaccattgacctttctggtgtcaaatctaacatttatttttcaggccatatcttatttcatctttccacaacatctgatacagttgattcctctacttcaccttcttcactttgcttgaaggacaccacagaaatagaacatggccagactcagaagtgcccctgggaccctcttccaattaccatcattttccttctctccaagtgagccactttctagctttttatcatcattactttctttctcttatagcttttccatttcaccatggattcctaaaaattatacttgatttttgtctgtttttttttgagctttctctaagggattatgcaaaagacattatttttgtgtcaggcttcttttattccacatcatatttatgagctatatctgcattgagaagaactataggagtaattttcttcactttatactagttcatcagaggaaaatatcacaatatatttattctacagttgatagacacgtgaatttgtctgggatccagttcctggaccatttcagactcgtgttctagcctggcttcctagctgaggtgtcttaggaatggtggtactgttcctagctgctgctacagatgggaagccttctgtgctatgctgcctggtgagaaagatgctgtagctatgccccagccagattggtcctgtaaggctttggcctttccagttgttgcttggagaaattgctgactcaccttggaaaaaggaggagttaacagctcatggtggattttgaccaatggaagatggagaagaggaagaagctgaggataaattattttcttttccaatcaccaataaacagatacatgtgaaatgaggtacttagatggcctcttagaaaacatcctgggagatcaaggcatcagttgcaattgctgtcaaataaaggccagttctgttccacttcccctgtgttttctcctcttctttccatacctaatttgggattccttttcgactcactcctgtgtctctggagtcatactcctcaataaaatgggagcacgtacacttttgactaaggctctgttttctagaaagcccagaaaatccctcccaggaccagctacatagttggttggaccaagtgcaataaaaatacaggggcttttgctcaacaattattaagaatgttaagattatggcagtagaacattaagccaagtggagcccttctaagccctgggtcctatgtgacctcacaggtcatgtgtccatgaagctgaccttcattcctcccattcagctccccacaacccccagtcctccaattctccataccccttcctcaagtcctccactattacttgttcatgtgtgctgctagaaaatacctatcatttatctatccatctttctatcatctctatatgtggataggtgcttttttttttttttttttttttttttttttgccaaacactagttttcaaagatgaagtgctatttttaaagggactctattatcctggggaaaaatgtttacgtatattagtgaggaggaatttttaatgattaagaaagattatgtctgttacacatactaccatttgatatatgacagcttaactttttttttttttttttgagacagagtctcgctctgtcacccaggctggagtgcagtggtgcaatcttggctcactgcgagctctgcctcctgggttcacgccattctcctgcctcagcctcccgagtagctgggactacagcacctgccactacgcctggctaatttttgtatttttagtagagacagggtttcaccatgttagccaggatggtctaaatctcgtgatctgcctgccttggcctcccaaagtgctgggattacagagcaagaacatcgccatcttggacaagcccctcattctaaagtttaccttaataaaaaaaacgcctaaatccaaagggcatcagcctaatggttaagggcagcatgaacatgaaccacaaataacatctccaaccagaaacattccaagctcctccccagccagagacatgctagccctgagataacccccctccagccaggaagttgccaacctcaagataacactcctctggctagaaagatgtcgtcagccccaagataacctcccctcctcccagagacattccaaccctgccataaaacttctccctcacacagaaatattccaagcttgtaataaaccccctcaccctaaaaccaatatatagtcttagtctgtaagagaaagtgctcctgactgaaatcggccagaagcccctctcatgttttatctaaaataaacccatctttactgtcaagccacgtttcatgtttctttcctatttctttaactcttacacaaacttaattatttaatatagtcatatatagttcacccatattactgctttattattttaaaatgatttatttgggtgtttattaagtcttgattaagcacatttacacacacatgtgtcacaattctttgacaagtttaagttcagttcttggcacaggtaggcatcccataaatggtattattcctgcttccctaccataagtcagtagcttttcccatctttttcttttcctatcattgcccccctcctaggattgtcagattttgcataaataaaggttaaaatttttaaaaatgtaaaaattaataatttaagtattagtgaaaatacagaatgcccagttaactttgaattgtcagataacataatttttagtataagaatgttccaagcaatatttgagatatagaggtatatccaaatacttcccaaaagttaaaaagaaaaaaacctattcattgttgactgggcacagtggctcacgcctgtaatcccagcattttgggaggccaaggtgggtggatcacgaggtccaagagatcaagaccatcctggctaacacggtgaaaccccatctctactaaaaatataaaaaattagccaggcatggtggcacgtgactgtaatcccagctacttgggagactgaggcaggagaattgcttgaacctcggaggcagaggttgcagtgagccaagatcacgccactgcattccagcctgggagacagagcgagactccgtctcaaaaaaaaacaaaaacaaacaacctattcattgtttatttgaaattcaaatttaactgagtttcctgtattttcactggcaaccctaccccttccaccactttggattataaggtctctgaatacaggcttatgcatgctacactgtatctttacagtaaaaagagcagcggtagcttcttaatatgtacttatagattggaggaaaagtctttgggatgaaaagcatcccaaacaatcagatatttctttttttggtattttttttttttttttttttttagtagaaatggggtttcaccatgttagccaggctggtctcaaactcctgacctcaggtgatccacctgccttggcctcccaaagtgctgggattacaggcatgagccattgcgtccggcctacagtcagatatttttatataatttcccttaggaccttctaagcctagattgtttattaataatttatgatcctatttatcacgagcactgcctggaagtttataaggaaagctgtactataagggaacaaacatttaccttggcaattctatagcgtgccagcccaggaagacagtcgcatacaaacctttgtgtgtctgcctttgttccagaagatgaatttataatggcccttcagagacagagatactttttgcattactctatagttttctgctttcatctgggcaaataatgtaaacttaatacaactttctttgtcttttctcccaggttaattgtgacctctatgatggggatatgataaagaagaaaagtacctcacagcgatgattggcatgtgatcacttagccaatgagataagaggctgtagaaacgatgtgataatgacatctcctgagttgcaggtccatattagaagtggatatgaagtaaacattgagctttcctcacatttaattaacaagctttattatagatacagctcaaattagttaattcaggaagcttattttgtagaaattaaaacattaataaacacatacatttagaaataaagaactcggctgaccctttgactctttgaaacaagtggccttccatgctgtgaaagattgtagccactctttgagacattggaatggtgtccattgcattttatcaagttaactataggtcagcctgggaaatctgaagtttccttatctcctgtcactgtggttgctgtgagattttgtgtcatcactgtgctgtcttccctctccacatgaaggtgagctgtctggcttcactctaacgtttgtgatttcacgcccgacctgattgttgccaagcaattcctttgtttggagaattctgtgctttgtttagaattttttaaaggttcttttcctgtggtcagatttctgtttgctactgtgtcttatgccttgttctcctacagagaagattctttgaagttagtggaagctcagcttaaaggaagatctactgctctgtgtggtggatgaccatgggggagcgagaaggcagcctccggcttttgttttgtgtgtgtgtgtgtgtgtgtgtgtgtgtgatgtacctggaaaaataacacgactaggattaaagagtatgtttggcatgtttaaaataaattgtaaaccaaacgtattttaaagaatttatacaaatttgtcatttagtaaaatgaatgactattgagtattcatgtcaataaaacaaccacttgaatacaacaaagcatgcgttgcgcatgtttctcccactgtttttctccatctataacctccctactcatcagtttgagattttttatatggaataagtgtggttcttgcaaggaaattatctttagaataaggataaagtatttaagaatatgtacttaaaacttagcaaacccattggaaaatgatccagaaaaatggtattcagagataaaaatcagaatgtgtttgggagaagagcactgacgaaggttggtgtatgtggcatgtaaataatacattgatttagatggacttttactatgggggaaagctcatcaagcctcacgtaatgagttagtgtctacccttttctttgaaaatttcattttcattacaatgggttttgggcatttgtactttgttatctcttcaagttcatacaattaaagtggaactcgacttcttttgcttggagatactaaaaattctgtgcagtggaaggaactgtgacctttcttaaatgggtccatcttctagctcaaaaaaataattcttagatggtgctttaacgcctagttttagtgcaagacagattgtcagggtaataaattaaaggcacctcactgcagcgctgttggccaatgttctaccacaggcccatattaatattttattccctttaatattattacatgatgcaggctttatttaaatggatttgatgggtctcttggttggcttgacaaccagagggaaaaattaatgttctgcatttaatctcagctcaaggcactaaattattttggaggtcaaaatcgtcatgcatatcatgctaaattattgaatgtaataactattagctagctgtctacttatgggttttaaaaattgtttacttcatgcatcttgagctaattttaaagtaaatccctcttttagttttttccctcctatatgccactattatcttagcccttgcaattgtgataatataactaatggaagatgccaggtgcccttcttgtaagtgaaatctaactgactaaatgttaataaatcgccaaaagcattcctccttttgctggttccatcttcatatgaagttcaagtatgttaagagaaatagtcattttgttgtaatggaagctattatcttatttaaaaaaatcacataatattttgccaaaaagaaatattgattactaaaagaatacagtaagccatattctaattattttaggaataattggaacaacattaaaaaagaaatgatgctgttggatttctttttaagaaatgatttaatgggagatatgacaaatgaaatataaaatgatgtatttattatttacagtgaaaataactcacatatccttgtccaaggtatgatcttaagaggtgaatcaatgtcaacagtattatgaaatatttaggttgtataaggatacaattctggattcttggacatttgtgtaatgacttgtaagtaagtgtggcttgagagtaggcttttgtgtctttctatataagaaaggtggtaaggggaagtttgaagacacctgttatcctgtacagtttctgcctcctctggattttatcttaactagagcaagcaattcctatgtatgaggttttctggggttaagcagttttagctggattacttaaagtaacatcagtcatggccaatgggccatgatgaaaaaagagcttcaaataagaagctgatttttattcctggtaatgaatggtgatgtgccaaaaaaaaaccacaaaaacctgcagctctttcaacagcagggtaacagcttctgtgcatatggagagtgagcacttgacaagactggctattggtgtacaagctggaccttattgaaagggctgaagcagcactctttatgccatctttctttctgtctttcctatcttgcttataaattactccattcatctaagtgaaagcttttggatgactgttagtgtggaaatggtgggtctgtctagtgactcaagatagcttcttggtggcatctagtcaagcagagatagatgcaggtggcatctaacaagcaaggagtaggtgaggaccgctcagcctctgtcctcatcagccactgaggtaaatcaaatgactgataaccaggtaataggcaggctgagggtgctgaggtgaggaaaacagtttaacttcctcaccaggtgcctgacttcctgacaataaacatctaggacctatgctgtgataatgtcattgggaggagatatgtttccttttctttctcttcatccagtgactcaattaatgcaagaacaaagcaaaacaaaataaaaacattttcaactagtacttgctatgctggggaaatggaatagagggttgaataagactttgttccctcccttgatgagtgcataggctactgtcttgcttaatttgttgacctggtacatgtggctctttcagaggaatccttggagaaagcatcaaaggcaatcaaactagggaaactaggaaggctgtgtggagcagaacaatgagccactacagagataggacttcataacaggataggaaagatagaggagataggaggatgtgtatctcatcttgggacagagagaggctacattcaaggtgtgagaggttttgagatgaggattaaagaggatgtcagcgcttggtgaattagaagtagataagtctttttatttgtttgtttatcttttggggtttatgagtttctgagacctaagtattttcataggtgacatttttgagctggatgttttgacttctttaagatctgtatttgtatctatcaatatagttatatagatatatgtataaagattctccttgctctccatctctcttatttaaagctggacacattttatgcttagacagagttttaggctcataagagctgggatgggataaagagacaaagcagcattttgatacagggccccactctgtcacccaggctgaagtgcagtggtgcgatcatagctcattgtagcctcaaacttctgggctcgagtaatcctcttgccacagcctcccaagtagccaggactacagttgcgtgccaccgtgcctggctaatttttacatatttttgtagagacagggtcttgctatttactcaactagtcttgaactcctggcctcaagcaatcctcctgcctcagccttccaagacagctttctttaaatgtttcatgctactatcccttaacatctgtactctccagaggaagaataatattattacattttagtgtaaaataaataattggagaaaaacacatttaattctgtgactaatggcatttgtaagaaatcactttgtagatttttaaaaagttcttcctttaaaaatgtactttaaaaagcaacactctctccttatgcaattaggaaacatgtcacaacaatttttgtgccaaagctttataaaaataaaaaagctttataaaaataaagaaattgctgggcgcagtggctcatgcctgtaatcccagcactttgggaggccgaggcgggcggatcacctgaggtcaggagttcgagaccagcctcaacatggagaaaccccatctctactaaaaatacaaaaaattggctgggcttggtgatgcatgcctgtaatcccagctacttgggaggctgaggcaggagaattgcttgaacctgggaggcagaggtttcggtgagccgagatagtgccattgcactccagcctgggcaacaagagcgaaactccgtctcaaaaataaataaataaataaataaataaataaataactttgaaaaactgttattgttaagtgatgccgcccataatcctgctatcaccctgagatgtttgtcttcagtagataaaaaaagtagagatgctaatcattttctgttatttctagaaaagctcattagtaaatatggagtgacaatctctggctagaaaaacagaacaacccctgttgtaaaggattctaaattcttttagtagttgcaaaatcataattggcatattaaataattgggatccgtgaacagacttcagagttctagcaggtatctatgaagagaagtaaaagattgaacctcaaataggataaaagctgtcacaattagtttagccaggtttgataacagctaaggatgagtgggagaaatatcatttgttcttgaacatttgcagtgtatatgctttacttattggatatcgaataactaggttaatcgggtgtactgaatttggtagagtacaatttggaaacaggtttatttttctgcctctactgcttttgtggatgtctcactgttatttctgggtgacatcttgtatgaaacccatagctttaaatacctttataaattttaaaatgtccagtctagtctaaattagaactttgttttcttaagctcctctacccatctctctcacctaagcaaagtaagatctggtgcacttccataagctcctgtttttatatcctctctcctctgccctttgtctggcttctccaagcagggttgaggagcagggattgaggaggaaaagaagacagaaaatgtggcaaagcccattttacttacctggtgctttgtctggtgtttctagctctttcttaattttcaagtgacttttctcatggcaagccttctctcatggctataatagtgggcccctcgggggatgcaaaagaaatttccacccttcttagcttcctcactgtataagggagggcaaagattaggctgctctaacaaagagaacaaacacacaacagcttaaatcatgcatccttaatggtagtgaaaattggttattggcaaagggggaatgaaaagcatcttagctattacaatggtttgtggccttctaacatccaataaggtctaatttctttggatttaatctctcttgttagaaacataatcaaattaaaataaaaaattaataggattaaccttaagtttatttattttctttttcatggagcaataataaaaaaaatgatgaacatttgcttaaatagggatttattactctctcacttgatagtccagctttgcctgaaaagatcatttagggacccgagttctttccatctcattcttccaccaacccctaaggtgttaacctggtttgcatgaccaaaaagctgtcatggacatgtctgtttttcagagagagaagaggaaagaggtgaatccaggacaagcaacttcattttagcaagtgaggcagaagttgcacccattacttctgttacattgcaatgatgataacttagtcatgtggtttcttttcatgggaggaggctgggaaatataatttgaagcttgacagtcacatgtccaacaagaagggaaaataattttgtggggacaactagtcatctgccatactgaccaagaaaatgcactctttgaccgcttctgactccctttcactgttgcctttcagtgatatatcccacacggcccctttctgctgtggtccctcatcctgcaggcagctctcttgggcaatatccttcgaagaccattctagctgatcatgcaaagtgtctatatggccaaaggaagctcatataaccttgctgcattatatggcagaggggcactttgatctcataactgcattctcttctctttgctctgtgcatatgaatagctccagctagcctgctatcttcagaatttccaaataagaagatggcaagtgtaaggagacatgttaagatcttgtagaaactctttggttttctattctgttagcagcagaggcaggccttagcatttctttcaggtagggagaaagatgcctggtgagatgcaaggctcttctcttgcaaacgtctccaggcacgtagaagagttcttttttttaaagcttcctcacttgccttggcagctgaaaagcaaccctatactctctcctataagaatagtaagagaaatgccagaatgtgttaaattttttttttttttttgcttcaaggcattattctttctgatcagtttcaaacatttcaaatgattcttataaagaagggtaggagtggggtggatctatgtaacgaatgctttttttttttggtcttagttcaggctgctatagcagaagactgagtggctaataaataacagaaatgtattctccacagttctggaggctggaaagtccaagataagggtgtcagcatggccagattctggtgagagtcctcttccagtttgcaaatgatctgttttctttcttatatcctcacatggtgcaaagagggctagaaagttctctggggtcccttagggcaccagtaccatttatgaggtcttcatcttcatgacccaattatctcccaaaggccccaccttttaataccatcacattgagagttaggatttgaacatatgggttttgtggggacagaaacattcagtctgtttcatttttggtaccctgaatctgattcttttgcttcattttttttcccaaattccagccatggctgtgatggacagaattaagtatgtggctatcattccacctcaagcatctattatagatctctccatttctctgtcttaggaccttctgtaaatagcaggggtccccttggccccttgtaggttgagtcccaaagtgcagtgcagttaatattccaagcaaccctcaaccagtggacaaacctgtagacaaatgccccagactcctcttttctgggtacgccatcctgtggggcattctgtgttcctcagaggttcctgcagaagggaacccctgttgcctgtggcagcagcctcactaatgccccatgagttggctttgcaccttccctgtcttaattttcctgtttcttcactcttgttttctgggacagactgctacatgaactagctgaatacaaatactttcctcagactctcttttctaggggagcccaaacaagggaactgtcctgttacattttagtaagtcttactgctacaggtttggtggctctctttagaatgtagaaatacttatttttatgagttttgggtcctcagctaaaactctgagtgaacagactttcatatttatcttttctttcctatgatagtatattttcttaaattcacttagcttcatattagaaattagtgtttagttaaacaaaaggcttgttttcctttttaaaaaagacattcttgaatgaattatgtgctaatggccttagatttagttatctgagaaaaatatggccaattggctagagtgcaaaatatcaagtggtcttatttggtagcctaactgtaggcatggtaaactggaataattagcttatgcaggaattggcttatcacctatggggcaacttctacatcacaatatctttatgttttaaatttgaaggcatgcatttttccttttgcaatttttgatgttatgtcctttgtcttgaccatataaattgtacttagaatattgtatctccacagtgaatatttgaagagaaaacgaagaggttattaaatgtgtttgggaatatcataattataataggtaagcaatattcatgttgttactattgtgtcttttcctttgtaattattaggaaagctagtggaaaaaataaaatagaagtatttgccttctctatgcctttttggaatgaaaaataattggcacttgacatgaaatagaatacagaaaccgtatcctgaagcacgcagtcctcccttcttcctttcaactcttttgtagaaggtcaacttgtatcctacaatttactaaaaagctattattattgtgttgtagcagtatttcttcaagagttgaaatgatagctggctttagtatagaaagcctgataaaactgttataaatcactagtggtttgggaaagaagactagattcttatcacttatgatttctacagtttctcagagaattgcttaggacttttgagtctctttctgttagtatctccagcgacttaagtttgttggatttgatggaaattggtaagaacgcttgaaggttattcagaaagtttgcttccaaccctcttgtaagaaatatgttcacagttgactagggagtaaagtaaactttcttagaacattgttaaaacaagctactgcatcccttggctcaattcttccctactacacacaagaaacagcttctaattttcacaactgcacaatcaaagtttctttttccgatgttgtttatgacctagttttaacattttgaagtattctttcactccttttctagtgtgaaaaatggtgtccatccatcattaatttatgctgctattatgcagccaaaatgtgcttgggaatccttttggggcctccaaaggaaatctgagggatggattttatgttcagcaaaaccattcttgaaaaataaatgtagatagatgtacatttttaaaaagaaggagaagactttttaaaaaaagtttaaacagctttattgagatataatcatatgtcatacaattcactcatttgaactcacacaactcagtacacacaaaaaaatccaaatcatctcattaaacaatggataaagaacatacatagacattttgcaaaagaaaacatacatatggtcaacaagcatatgaaaaaatgctaatcatcagataaatgcaaattaaaactacaatgagatatcttacaccagtcagaatgaatattattaaaaagacaaaaaaaaaaaaaaagaagagatgttggtgaggatgcagagaaaatggaatgctttcctttgcatcctcctactggtgggattgtaaattagagctacctctatggaaaatagtttggatatttatcaaagaactaaaagtacagctactatttgattcagtaatcccacgactggacatatactcaaaggaaaagaaatcattatataaaaaagatacctgcacttgtatgtttatagcagcactattcacaatactgaagatatgaaatcaacctctgtccatcaacagatgaatgagtaaagaaattatgatatatatatatctcacaatatatatttcacactgtatatacacacacaacagaatactattcagccataaaaagaatgaaatcatgtcttttccagcaacatggatggaactggaggccatcaccttaagtgaaacagctcagaatcagaaagccaaatatgtgttctcacataagtaagagccaaataatgatatagacataacttgtggaacaataatcataggcgacccagaagagttggggtagtagaggcggttgagggatgagaaattacttaatgggtatggtgtacaccatttgggtgatggtaacactaaaagcctagacattgccactgagcaatatatccatgtaacaaaactgcacttgtgccccctaaatttatacaattctttttttaaaaaaagaaaacatacaactcaatgcattttgagtattttcacaggtatgtacaactatcaccacagtcaatttagatcattttttattactacaaacagtagccctgtactttttagagcaatccttctatacttttaccctcccagcctcaagtaaccaccagttgaatttcattctctatacttttacctattctgaacatttcatataagtatatatatatattatgtgattatatatattatgtatatataacatgttatgtatatatattctgttttttatatatatatatataaaaatatgtttttctgtgactagcttcttttccttagcataatattttcaaagctcttctagttgtagtatctatcagtacttcattcccattctatggatatatcacagtctatccgttcatccatgagaaacatttgggtaatttccatcttttggctattgtgactaaggatcctatgaaaattcatgttgaattttttgccagaacacctgttttaattattttgtgtatatatacctgggagtgaaattgctggatcttatgctaattccatgtttaatttattgaggaatcacaaaattattttccacattggctgtgccattttacattctcaccagcaatgtaaagaaggggaagattttaaaaatatccccaattcaaagaattccagacctaaacacttcctggctatgaaatatcttcatgaattaggagactaccctggtgctagctttcatctactttatagtcagccataagttaatttgattttattttgtattcaaagggctacttaatcattgatttgaatgctgtttcaactaattaacattttaaaacaatgtagtaaaataaaaatatcagaattgtctatattaaattggcttagatttaaatgctgcaacatggacttttctctctgatgtctggtggtcattagcatagattagatacaggaatttgcattttagaataaaactcttacagaaaagaggactgcttgggtataaaccaatatttctcaacttgatgttttctaaggaatcattttgttacaggccatcttagagtctgaggtcaaaaatgtaagaaacaatatgttggtcactttttattttacctccttgacagcttcctcgtaagtatctactgaaactatccccttttcatcatagtgccatcagtaccttagttcagacctttatggagttatgcctaaaatattgcaaccgtcttccaaatgcctagtgtattttttaggcctgatctcacattttcttgagccacctttgtgctccaactattgtggcctctagttgtaagcatctgttgcacctcagttgtatcgcatacctaccctaggtcctctctgccactgctatttaggattttgtgagagcacattcacccattctgatgaatgtacaaaccttgaagtatgagaccattaacactctctctgtaaccattgaccaatccacatcaatgttaatgtagatattaacctcgtcttgacttgagtggattgtcctaaagcacattctacgtagtttctcagaaggttcctattgtgtccttgctcaatttatttgttggtctttgcaaaaaccaaacagatgtgacatacgacaatggctgactgtaaatgtaacctattattagccctaatcccaagtgttgtgctcattgtagaatctttactgtaacaaatcattatagaatataatgatttgcaggagaattgcttgaatccaggaggaggagttggctgcagtgatccgaggttgtgccactgtactccagcttgggtgacagagcgagacttcatctcaaaaaaaaaaaaaagtatcctgtgtttatataggaaagacagcagtacatattcactctcttgcccccaaattccactgcaatataatcttcagggatcttgatcattaaaaaattctgtgaaaggtcatggtattttgctatattaataatatacaaattggacttgctgagcagcaaataaaaagtactgtgggtacattagttaacacccatgcattctagagtctgggagataaaccttataagattttaggtttcagtccaaggggtgacttttttaggtatgtagatatctttggtgtgcttggacattctctctaaagtaaaggaaaatttgttgcatcttgcatttactgtcactaagaggaggcataatgtttgatgggtttgtttgaattctgaaggtagcatatgctgtgcttgggaacaatattcttactcttttattggataattcagagtgacactagctttgagtgtggctcagagcaagagaggctctgcagcccatctaggttaggttaaaagttgcccagcaatcccaaatgtgtaatctaacagaacaaatagtgttagaagtgatcataatggataaggatgttgtgtgatgagtcacaacatagtcccttaaggttctggagcaaggccgtaccttctacagcaaagaatgactacttgatatttaaaaagctgcccttgacatcctgctgggccttagtagattggctacttgaccatggaacatcaaatgagtatgaaactgagttgctaatcatgttgatagttcaaacccactgcatcatgagattcggcattcgagggacactttgttcaatgcaaatgttacattaaagactgaatacaaacaggttctgaaggcataggatgttgcatgacaagtggcctggactccatgtcacctatttctgttgtgccaattcctgtcctacaactgtcacctgtggactcatgcagggttccctatgatcaaccagtggtagaaaagtctagtttacagattgcttggatcaatatgttggtggtagctaaaaatctacaagggccaatctggcaacacacacaactaactttgaaagacagtagtaaagtgaaattctcccaaggaactgagctgcaagaagttcacttggttgtgtgcaggaagaaatggctggagatagggatatcacagatgccagaacattagcaaatggtttgattgctttgtcaaagatcttgaaataactaaactggaggataatatttaagaaagtttagagcagaggctggtgggtggaccatgtgaatggatacaaagcacataaatcttaattactaaaatgatggaataatctgttaagggcttaattaagatgccaggtcaaagacaaccccatatagtgttggaaatgcaatcttccattttgttatgttgctgatatgtggttctgtgtgcagaacctaaggggtaatgtggcttttggcctttcaatcatcacttccagtgacacaatttcagaatttatcatctgtgctcctacaattttaaactctgatgaattggaaattctgattactgtggtggtttcacagaacctgaagctgcaaatagtattttgtgatggcaataaaggtttcactaaacctgaatttgtaactgtcagctgagatagacagaagaaattgatcctgattatcatgatgatctggagttgactgccacacaatgagagcaaaaaggattttctttagctactggaggattcactggtggtttttttttttttgtggcttcatgcacagtgataattgtatatgggtaattgcagctgctctactcaagaataaagtcattgcaggcttcaactccttaaagataaagtgctggcagagacagagacactccgtttgtttgggagaaagtgagagaggaaaacaagagtttctccctggtaatccagagaattcttttatatcttatccaagaccaccaaggtggggcctctatgagtctgcaagaaccatggcattactggggttggggtgcatcctaatgtagatacaacttagatcacaacacccaagtccaaatgcagatacaacttacatcacaagacccatgtcctttggaaagtcttctaaagaaggacaggtacaaacaagcccaaactactaagactaaaataaatacctaactcttcaatgccaaaacagtaaaaaatatttacaaaccccaagaccatccaggaaaacataatttcaccaaatgaactaaataagtcaccagggaccagtccttgagaaacagagatgtgtgactttgcagacagagaattcaaaatagctattttgggtaaactcaaagcaattcaagatgatacagagaaggaattcaaaattctatcagataaatttaacaaagagattgaaataattaaaaagaatcaagtagaaattctggagttgaaagatgcaatggacatactgaagaatgcatcagagtctcctaatagcagaatggatcaagcagaagaaagaattagtgagcttaaagacagattgtttgaaaatacacaatcagaggagacaaaagaagaaataataaaaaacaataaaacacacctacaagatctaaaaaacagaggatatagctattttaaatatatatgcatccaacatgggagcagtcaggcatataaagcaaatgttattagagataaagaaaaagaccccaatacaataatagctggaaacttcaacaccctactttcaggattagccagatattccagacagtaaatcaacaaagaaacattggacttaatctgcactatagaccaagtaaacctaatagatatttatagaacattctatccagtggctgcagaatacacattcttctcaaaacatggatcattttcaaggatagacaatatattaggtcacaaaacaagtcttaaaacattcaaaaaaattgaaattatatcaagcaccttctctgaccataatgacatgaaactataaatcaataacaagaggaattttggaaactatacaaacacatagaactttaaaatatgccctgaatgacaagtgggtcaatgaggagattaagataaaacagaaaaatttattaaaacaaatgataatggaaacatgacataacaaaacctatgggatacagcgaaagcagtactgagacgtttatagctattagcacctatataaaaaaataagaaaaaaatcaaataaataacataattatgcctcttacagaactagaaaagcaagagcaaacaaaacccaaaattaatagaaaaaataataaagatcagagcagagataaatgaaaatgaaacaaagaatataaaagatcaataaaaattgtttttttgaaaagataaaattgacaaacctttaaccagactaaaaagagagagaagacccaaataaataaaattagagatgaaaaaagagagacattacactaataccacagaaattcaaagtatgattagtggctactatgagcaactatatgcaaataaattggaaaatctagaggaaatggccaaatttctagatacatacaacctaccatgagggaagcatgaagaaattcaaattctgagcagaccaaaaagcaaagtactaagattgaagtcataataaaatgtctcctggcaaatacaagtctgggacctgatgtcttcactcctgaattctaccaaacatttaaagaagaactaataacaatcctactcaaactattaaaagaaaatagaggaggagggaatatttccaaatgcattctgtgaggccagttttaccctcgtaccaaaaccagacaaagacacattgagaaaaaggaaaactataggccaatatcactgatgaatattgatacaaaaatcccaacaaaatatgagcaaataaaattcaacaacacattgaaaagatcattcatcatgatcaagtaggatttatcccagggatgtaaggatggttcaacatatgcaaatcagtcaatgtgatacatcatatcaacaaaacaaaggacacaaaccatacgattatttctattgatgatgataaagcatttgataaaattcaacatccctgcatgatataaaccctcaagaaactgggtatagaaggaacataacataataaaagctatttatgacagacccacagctatgcatcattctaaatgaggaaaaactgaaagcctttcctttaagatctggaacatgacaaggattcccagtttcaccactgttattcaatagtattggaagttctagctagagcatcagacaagacaaagaaataaaggcacataaattggaaaggaataagtgaaattatccttatttgcagatgatatggtcctatatttggcaaagcccacagactccaccaaaaaactattagaactgataagttcaataaagttgcagaatacaaaattaacatataaaatcagtagcatttctatatgccaacagcaaaggatctgaaaaagaaataaaaaagtatttccatttacaataggtacaaataaaataaaatacctaggaaataatccaagaagtgaaagatctctataatgaaaacaataaaacattcatggaagaaattgaagaggacaccaaaaaatggaaatatactccatgtttatggattagaaacatcaatatttttaaaatatccatactacccaaagcaatctacagattcattgcgatccctgtcaaaatatcaatgacattcttcacagaaatagaaaaaacaatcctaaattttatatggaaccataaaagacccagaataggcaaagttattttaagcagaaggaagaaatctggaggaattatattacctgacttcaaattatactacagagctatagtaaccaaaatgacatggtgctggcataaaaacagacacatagacccatgaaaccaaatagagaacccagatataaatctatatgtctacagtgaactcattttgacaaaagtgctaagaatatacattgaggaaaggacaatttcttcaataaatgattctgggaaaactggatattcatatgcaaaagaatagaactagacccctatctcttgtcatataaaaaatcaaatcaaatggatgaaagacctaaatataagacctcgaactatgaaattactaaaagaaaatattgggacaactccccaggacactggtgtgggcaaagatttcttgagtaatacctgacaagcacaggcaaccaaagaaaaaatggacaaatgggatcgcatcaagttaaaaagcttcttcacaggaaaggaaacaatcaacaaagtgaagatacaacccacagaatgggaaagaatatttccaaactacccatctgacaagggattaataaccagaatatataaggagctcaaacaactctataggaaaaaatttaataatctaatttaaaaatgggcaaaaggtctgaatagacatttctcaagaaagacctacaattggcaaacagatatatgaaaaggcattcaacatcactggacatcagagaaatgtacatcaaaactacaatgagatatcatctcaccccagctaaaatagcttttatcgaaaagataggcaataacaaatgctggcgaggatatggaaaaagggaaactttcctttccttcttggtaggaatgtaagttagtacaaccactatggagaacattttggaggtacctcaaaaagccaaaactagagctaacatatgatccagcagtcccactgctatgtatataccccccaaaaaagaaatcagtataccaaagagatatctgcactatcagaaatcagtatacccaagacatatctgcactatcgtgtttattgtaacactattcacaattactaagatttggaagcaatctgtgtccatcaacagatgaatgcataaagaaaatgtggtacatatacataacagagtactattcagctacaaaaagaatgagatcctatcatttgcaacaacttgaatggaactggaggtcattatgttaagcgaaataagccaggcacagaaagacaatttgtgcatgttctcatttatttgtgggagctaaaaatgaaaacaattgaactcatggatatagagagtaaaaggatggtgaccagggcctgggaagagtagtgggagggggacatggagatggagatggttaatggctacaaaaacaattagaaagaatgaataagacctagtatttgctagcacaacagagtgactatagccaaacgtaatttaattatacatttaaaaagaactaaaagagtgtaactggattgttagtaacacaaaggataaatgcttgaattgatggatacctcatttaccctgatgtattatgtattgcatacctgtatcaaactatctcacgtaacccataaatatatatgcctactatgtacccacaaaaattaaaaattaaaaaacataatgtgctggctgagggtgagaaatgtaaaatgggtggcaggtatgattccatcttgaagcaccaggaactgaacaactaagccttcttattccttttaatattatttttggtatcttcttatcttttgtagagattgtgaacatgtcaacttaatgactctgtgatacataatatttttctttgattctaagcatatttttcattatgtgcattaactgtttcagagaaccccaatcaatttcattcagttcactcattcatgtattcagcaaacatattgagaaaaggacttactaatgactcttcttatctcagtgatgtcctatatttaggaagctttttcctgtctggaggaggctggatttagttaatcttagctccttcaggctgaggcttaataaggatcatacaccaatactgacaggcagatagaagactgagacaagaaaatgcagtcaaaaaagtcttccttgggtacttctaaagtattaatgtatgctctccattatttcataagtgctgctttagggtacaaaatttgcaaccgaggtacccaagtttaattattcatttctgctccttattagttatgcaaacttgagcaagttccttagttcctctaaatcttattcttctcatttctaaaatgaggatgaaggaatccctacttcatagaattatttgaggattagatgagataatgtgataaaataccaatcccagttttttttttttgcatgttacaagcactcagtaaatgataagtctccttgtcttcatcatatccccattcaccgttagaatgaattaccagttgctttataatatataggaaatatggctcttgagttttctggacacagatctttaaaggacttgagaactattggtcctatgttgacatttcaacctaccctggaagaagagttggtagcatggaagatatgtagtagaaaaaggaatgaggaaagtggtgggaagccacataaagctactacttaaagtatgaataattgtgaaaatgtctatcatactagaaattggaaaatataggggaagggtaatagtatcctattcttatgtgtatatgtgatgtggaaagggctggactcctcttctacattttccttttcaaatgtcactatcattggagtgagggtgaatctctggttaaaaaaagattggaaattttgagagacgtgggacaagaacattgtggggtgttatggagaattttggctaaagaatttcctcttctttactttgccatttatttcaaggactctttttcatcttgggagataatctctaatgccacagagctacaagcaaatattagggctcagagaacaggaggtagggtgctggatccttagaacttgctctaggacctaacaggttcatctcaggagattagtacagttgcacagattggaagaggaggcagggcagaaattctgactaggaatcaaggttattcatagagcaataacatttcctgggctgtagccctccaggaagcacgacattgcctgatggtgcaggacagtagtgaggaaatccagtgcaaacaactgagtcaataacagacaaacgaaaagccttatttttcactttacctaatggcaaaataaatgggttgtgacatgaagggataaatgataagtggcattttttttttcttgtggagggggttgtctagtcagccaagtcttctttccacagaagtggaataagtatgtgagataggttcctatcgcaggacacatctgtgtgataatatgatttatgtccctgtactctggctttgggactactgataaatatggggagaagggagttagttgatcatttttcgcttttcctcagcttacagctattaactgggcctgaggatttctttaagccagtgaaattaatgacaaagaatcttcagcttttaccaccattaattgcatttgatcagcctctcttactgaaatttcaattttgttggctggcgaaatcagaagtggaaaagttgtaaaggtaagggtgagtgtagtcatctgaaaatggtcagcctttctcagaatacagtactattagtggacagaagtactgatgggaggaaggatgcaatttgtctttatgagagtgttttaaaagatgagtgactagtcatgattgtcatgcctgtgattgtgaatatgattttaatggtctggacatgaaataagtctaaaaatggtcacaggctttgataagttgagagatgagtctgatgggtctatttcagattcagtagctgaacaatgataaacttaaaaactgtaaaaagcctctttgctggagactgaaacaatggctcgtaatgatctctacagattcttgaaaagtattcactttaattcaaggttatccctgaactcttggtccaatacttccggacttgatatgaaactgattaaaatattcatagactgtgtctcaaataattttatacttgacattccaagatttatctttttttgttaactggctcaaatctacaattttagatctggaagaaacattttggatcatttaatttaaactacttctcttaaagatgtagaaacatggtattctgagaaagtgtaaagttatatggttattaaagtactgattgtttatataaacttgagacttgtttttacaaccttgagacttgcttttacacatttgataacatagtaattctttgaaaactgttaagaaaaaatcttctttataaagaaatgctacttagtttgtatctctggtttgaaatgctcttggtttgtatcaacaaaagtaacgggggaggcaaactaccctgtattagctctcatgtggattcctgcagtaaactattgaccagacttcatgctttcattcttgcctctctataatctattttctacaaagtagccagaatcttccttaaaaaatgcaaatcagataatttggcttccttgcatttagaatacaatccacattccttactgtggtctacaagtcaacatatcatgttgtcatgggctgaattgtgtctcccccaaaataataaagtcctaatccatagtacctcaggatgtgcatgtaattgaagatgtagtctttaaaaaggtaattacattaaaaattaggtcattagggtggatcttcatccaataccactggtatctttaaaaaaggaagaaattaggacacacacacacacacaaacacggaggggagaccatgtaaagatagtgaaaagatagccatctagaagtcaaggagagcgacctcagaaaactccaaccctgccaatactttgatcttggacttgtggcctccagaattgtgagaaaataaatttctgttgtttaaatcactcagtgtgtggtactttgctatggcagccctagcaaagtaatacacaggcctatacctctcacttctccttataatcctcttctccttaacccttgctcccgatttttattgtttttcatcctctgcattcagcccagtaaacataaacataataaacatagtaaatgtgagcaaagggtcatggcatttattattctctatgcctagaatcatttgcatcctaatctttgattggctggctccttcttgtcccttaaaaaaaatgtcactcagggacaaatgttgtctccactgagaggccttccctgacctccccattcaaagtaatctttcaatcagccttggtcaccctcatgttatcttgttctttttattatagtgctcagtattagaaatcatgaaacaagtccctttatgaattatatagcattgtactcccaagcaagcctatcatttgtcctctggtgcctgaaatttttgttcttattctgactatagggatggttggagtcaaggtaactgacagacccctcacagaggtgctcatgcttgtccatgttatcctatctcttccctccatcctagagggaagatatctggagtatagtccacccagtagtttccaggctgcaacagtgtcccccacccgtactggattataatttttttaaagaggctaaagagaaatttgtccatatgcttttagtgtctcacagatattttgaatattaggttctgctactttattatggttccctctttctagggagtagaagtgaatccagggaaattgaacaggaaaatagtctgaatgataataacaattgccgctcctttataataacaactcattgttcttggaacaaacttgctaagttttatttccttgtctgtaggtccataacaatatttgcccaagggattgcttgaggattaaatacggtaatgtatatcaagtttctaagaaacagcctgttatgtattatgactcagtagcagttagctgcccttattgttgctaaatgttaagccctgagataaattttaactaaacctctttgatacaaatctatacctgaatgcattctatacttactttcttaaaatgtgacttaagcacagatatctgagtacctatgtgtatttctcaatattcaagtgctgttgttgctatttttagcctcttcatattaataattttaaaaactcttcctttgaaaataatgacagaaaattgacaaaaggctactctgtattcttaagggaagtaattataattatgccgagcagaaggtaaaattataatttgttagctattttgttatgctttaccaaaaatttatcacagttttagtgaaagagccataaactttagtagacttctaagatatagcaatgaatgcactgctattgaggaaatagagtcattataatgcaagaaaatgcctgagtttcattagatcctaagggaaatagagctaggttagacttgtgggaatcaatagaacttgtttttcaacttacatgaacaagtgatgctgaaatgactcagatttatatacatcataaatagcagtactggactttggctgctttttttttctcttggagttaaacttctcatgtaagaatttatgagatagaaaaaactcagtgaaggggaatcaactgaggccaactgctgtgtggggaaaatcaagagttcatatgtttagacttgccatcctcacatatcttgataaatattagaggggtgatattagcaagtgtttacaatgagaattcattttcctggttttggctcattgactgaggcaaagaaattaatagctttattttattgtatagcatgagcagcactttgtgtgtgatatgaaagctgcttatgtgattgatgtgttcattgcatcttatggtttatgataataaatgcatatatcacacaacaagaactaaaacagatatgttctataatgcgctcatctcattctattttcattatgattttttatccacaaacactgcacaagatgtacatacttgagtacttgtctgcattcttgtacatttccaactgcaaatattgctgttttgaaagtctgctgggatgggctttctacttcacactccttgaaattgatctggtaggaagagcataatatttcaaaccacctcattgcaatataagcattagaagcttactaaaaggctttttatgttgacgatagcctagttatacagacttgctcaataacagtaattgtcttggcttgtttcagaactccagtggccacacattttttagaaatgtaaatggcattctttactaagttagaagctcaagtggattcggaaatgctattgtttgtatatatggtatttgtttagaactttctaaaattcttctactttcctgaaatacctggtgataagcttgaaacacatttttaaaaattcagcatccaaaggtaggagacctatctctgtttccataggagggcagtataatattggaaagaaacataagaacttggaggtagttttttgtgccttataattaaaccatttcctgcaaggggagtggatggtatttcaaatcacactaataaatctatgggttaataacatgtgagttagaatagccatgcaccataatcactgctgtggattcatttgtctctttttacacagtatattgatttttccccttaagaatgtaacaaagaaagaactttataaaattcttttgtctttaaactctgcttgttaatatattcctgttgccactcatctactagtaatttcctgacaggtaactattgctgttataattggaaatagtcttgaaaaagtagttgctgtgtttctggagaaacttcttattactggtaattgcctgcataatgaattgcaagaactagatgacttcagccgagatcaaaagtgaccattaactcacctatctgcaaactgaagatttctgggacttgtatcttatggcaatttcatttctttttcactttttaaaagactcagctttcttctgtcaagttcataagtatcagctcacacacatttaatacttaccttgtcttgtgaaacctttccagcagatgaaaaaccatctttattaattcagaaatatgggagtagagggaattgtttgtgcatcttgattaaaaaataaacaagcaggcaattaaattgcatataggatattttacagactgacagcttctcattaaaattgatttcaggataatttcatatactgacatgaagtctatcgggttgtagttttggttttttagctcagacaacccaacactttcttcactcttgaaaaaggacatagattacaagttggtgtttttaataaccaataattttttcctttgctcatctctcttcacctttttgtttcctctgtgaaagcagggatagaatttgaaaagtgatgggaatgagaatcctcgagcatgaggagtttggtttcttgaggctccttaaggaggttcgggggagactgagaaacaaggcaatgtggaaaatggttcaaagacaagaacaaaaggtaatagattctctccttgaggaaactctagtcagactcaaaattttcttctcaactagaccatgacttttgggcttctgtgtttgtctctgcattgctcaattttagcaagaagctttccaagtcagtttagccagagtccttcactcacgatacttagttgggttcctcattctccacaatccccttgtgatgtctgatcactgtaagcatgcctttagcaacagacctagtcagttagcttagcctaaatgtcctctaattcttgatgtttttcttagtgattttttatccaatgaccctcaccctgctccttgtctatgaatttccactcttctcattgtatttggagttgagctcaatctctctctccaactgcaatgcctcattgcagtggtctctatacctatatctatagtccccgtggataaggtcttcctttctttctctaacaaataaatgaataatcttgttctataacagttatgattctgtgactcaagattagattcattattaggctcttgaatctttttgaagagaggtcaaaaacccctcttcttgacttcctgcttctcacctaagtgagaaggctttgaagactttgtcttcactcccgactgactgttggggatccattggtgagacagactccagaaccattgctctggacaaatatctgctgaagctggtaaggacagattttgattcttgagattctgatatactctctaaagctgggttagagtcccaggcttcttcttcttttttctttttcttttttttgagatggagttttgctcttgttgcccaggcaggagtgcaatggcacgatctcggctcactgcaacctctgcctctgaggttcaagcgattctcctgcctaagattcccaagtagctgggattacaggcatgcgtcaccacacccagctaattttgtatttttagtagataatggtgtttcaccatgttggtcaggctggtcttgaactcctaacctcaggtgatccgcctgcccaaatcccaaagtgctgagatcacaggtgtgagccaccacaatgttggaggtgaggcctggtgagaggtgtttcgatcataggggtagatccctcatgaatggcttgggccatcctcttgttggtaagtgacctctgtctctgagttctcacgagatgcatttaaaagtgtgtgacacctcccccagcccctttctctctttctcctacttttgccacgtgaagtatctgctcctacctcaccttctgccatgagtaaaagcttcctgaggcctccccagaagcagatgctggtgccatgcttcctgtagagcctgcaaaactgtgaaccaattaaaccacgtctccaataaattactcagtctcagatatttctttatagcaatgcaggaatggcctattacagtattcaaacgaaaacaaagtgttttacctaaatgttcatctcagcactattcacaatagcaaagacaaggtatcaactcaggtgcccatcagtggtgtattggataaagaaaatatggtatacaaacaccatggaatactatgtaggcataaagaaaaatggaatcttgtcctttctaggaacatggatgcagctggaagctattatcctaagtaaattaacacaagaacagaaaaacaaataccgcatattttcacttaaaactgggagctaaacattgagtgctcttggacatagagatgtcaataatagacactggggactattgcagctgggaatgggaggggggcaagggttgaaaaactaactattgggtatgacactcagtacctgggtgacaagatcatccatttgtactccaaacctcagcatcacataatgtacccaggtaaaaaagtcacacataaacccactgactctaaaatgaaagttgaaaaaatgtgcagttttaattgtacatcaattatacctcaatgaagttgttttaaaaattttgtggaaaggcatgtcaaataagaggagatgttgcttttctgcaaataaataaaagaagagacgcttttgcttttcctggattatatttgtatgagtgaatattacataagtaggcattatattaattgtaataaaattgtatgaaggtcatagaaatttttcaatatcttgttgtgtggttataatttttgttgtatgtcacagaaataaccaaattttcttgtcatgtgaactctcatcagatatttagaaagagaaaggtttatgaaactgtgaaccacaaatcaagcacataagaattaattacatggaactgaatgaactgacaaagagtgattgtcgttttgtttggaatatggctggtaatttaatgttttattttccagatttaaggaatcctgttccttctttctctcaagctatgcataacttacagcagtttggtaaagtatatctttgtgaacggagatgaaacatttattgtttttccctatctggtctttccaaaatttgtaaactattattgagtattcttatcgtcctggcaatataattatttgcataagttcagtcagaatctgttctccttgtaacagaatagaattggaaaaattatttgttttactaaggctttgactggaatgtcatatcagaaaatgatgtacatagaatctggctttaagaaacaacaattgattttatggggccaatgcttacaaagccctcttgggaaaactggcctggtacctggctcatagcattcccagttttacatgtgtgtaaggagatcactttttggcagactcaggaacctcatgatatcgtgggaatctcaagaaaagaggaattcactgaaatctatggttaccacaagaaaaatctggtggtgagttcttggctttggcttcctgggctcaaagggcttcaaaaaaaatctaatctaaaattccttattaaaggtctacgtggtcaatggctcttgctgcacttatgtaaataatcaggcttaatctgatgagactagatttattttgtaaacgaggtccaaaggaaggtgattgtagaaattttgtttcagtggaaaattatcatgcacccttgtgggtattagattataatcctgttcatctgagtgattttctgcctcttggtaacttcatttcactttctcccttgttatccatgtataaactggactatatcctgaattattctagtttcttcctatatctggttacaattctccaaactaatgtttccactttttttccccactctcctaacttggcatcactgataactaaaactgcccttttcctgaagtattgcaagctgaggctagatgagttgtcataaactaccaaaaaatcatagcaaatcatgtactgacaacctccatgcctgctgctatgtaggccactcaggcagttcaccaaaacacccaatgccatcaccaaagacatcccaattgcaagccagaatatttgtcagatgaccattgctgtcctccttctaccatctgaagagacttggagcccaacatctagaaatctttttgactggctgcctttaggactcaaaagccagccttccgaccaataatctttgtttttattttgtttccacagaaattttcctcattaaatgcctgaatgtttacaccatacagcaaatatcccatactgggccccaacagatgactcagttggctgttaatgaacgatttggtcaaaggtgagaaaatggacttatattatttaaaggaaagaagagtgtcttttttttccttgaacaagtgcagggactgacgaagattctttccttgatgaaactcttaagtagactctttcaaactctcttctcaattaaacgttgaattttgggcttctgtgttcatctttgcatcctttgtccaattttagcaagaatcctgctaacttagtttagccagccttaacctgtccatgatacttgatcaccctagacacctgacagagttcctcctccaccatcccccaggtgatgtctgatcaccctggcctgtcttcagcaagaagcctgttgggttggtttagcctgaaaactccttacctattgtttcctcttagtgatttttcatccagtgatgcccaccctgcttcttgtctataaattcccacttctccttattgtataagaagatgagctcattctctttctctcactgcagtggtccctacttgtattgcaatagtctcctcgaacaaagtcagccttgcagttctttagcaagtatcattgaataattgtttctttaacaaagaacattaacatttgattcaatgaggactttagaaaatgttagtgtactgccattgtgaaatgctggaaaaggaaattaatactaaaatataaattgtttttagaagggactttgccaaccttttgtttggctgatgacataagtaggcattatattaattgtaagaaaattgtatgaaggtcatagaaatttttcaatatcttgttgtgtggttataatttttgttgtatgtcacagaaataaccaaattttcttgttataaatgtcacacttggttcagttgagttccctgatggattttgtcattgccaagcatgagcttggagatgagtttggaagtaggggctggtgatattgaattaatctgcattatacaaaatgaacataatggtaattccagaggaaatcttagataagaaggacagcaaaacgtggagaaaaccagtccctcggaagtaacttaatggatgaaaaacttcataccttagttacaataatgttaccattaagcagttgtacgtacctgtgtacctaacaaggctgtatctgggatgatttcctggttgattaaaagcagtgtttctaaaggtagtcaagttgggggaaaaagaaaaagcaaaaactctcttaagagaagatatacaacagtattggcctgaaacaacttggatctagccatacccagggggttccttatctgcaaaattaaaatctgtgtactcagttttactttgagggcaagattatgaaaatggattattattactctaatggagagtcatgttttataattccccagttgaaccatcactaaattatgtggtaagaatgagtgggtggggaagcacaactggacaaaccgctgtcaggtctgcccacttgtgcacagagttgtaattttttccacgattgaagaggaaaacaatgttcttttcattcagatgtacatttattctaccattgaccatgatgtgacttggcccataaagttggttcctcctttgtcagtgtagattagattcgtatctattaagaattttattgtgcttacagaacagaaaaaaaaaatctcatagaattcacattctcaacttcccttcaagatatttgtgcagtttacattgaataaatttgttttatttcctttgactgcaaagcttttgatcttctcaactggatatgcgaagcactttactataggcttccttttctatgtaataaataaatacttattcagttgttgaaatctacatatgtggcttcttgaatattcccatatgttctgtctcttctatttaatatataatcatttattaggcacctactacatgctggccaccattctagtgtcaatggcacaacagaatcactgtgtccaagagatgatgtagaagatggtaagaggtggagagcattttcagttgaatgcttgtcttttttcttgctttgtgtggtgtgatatgtctgctggccaggcagagggtgtttagatattgttggattaccaaatgattgtccatacatttgctctcattttaggaattgattcctttcttacctctaattgatttttcatctattccctttgcctataaacctcttgagatgatgaactacagaaaaggcagaaggccttaatatgctatttaatctaatattatataaaactggatccaactttcccattactgttattactgtcttcttgcaacacaggactttccttattgaactgtaattatttgtgttttttttgttttgttttatcttgtcccagaatacgatggactacttattaacctagacctgtggttcctaaactatggcatcacagtgaattttataggagcatttcagagtatttcaaaaggccgagggaaacacaataatgtttgtcagatactgtgtaaactattagctcaaggtaattcacaatttcaatgttagatttcactacattccttttgataatgtcctatctttgtgaagctgagttttccgaacttgctgtataatttggaatctggataaataatttctctattttatctgatgctttttctattttttaaaagtgtttttcatctttcactgtattttccatttatttgcagatagaaacagactaaatgtgagtttgaggaagccctgaagccagtttcaagtatatggtgacatctctctggtggtcaggtggacctgatttttttctatatagcatttcacagtgagtatttttcttcctgtgtcttagccacaatttttaaaatgttttctttttttctgtttcacagtcactttcaatagtaagtctcttgctgcatatgttatgactggtacctgaataccagttgacagctcttataataaaaaaaccagaaagtaataacagtttatacttctgtgtgaagaaaagtgctttgttcctttatacttggtttgcatttgaaaatattcatgagtcctttgctatcaacttaaaaaacatatttaaatcaaagtaatgaagtgaagcataataagtttccagataccaatatgttttactgtgtctgaatatttacaaacaaataattttacttggcagtagaaatgtaagcaagactgaatttcataatttaacaatattttttcttattttgaatattgatttcttcagttatattatatacacataatgagggttctatctagtaagtcttaattattattttcttaaaacaataattttaaaaaaaacaacctctatctttcttcttgctattttggaaaatataattgacaactaaaagggtataatagaccgaaaaagctatgtccagtaaaaacagattcccagaaaacaataggtggaaatataatttatgatactatttaaaaatatatatcaatcttagtataaactctgagctaacttagtttgaaaatatataaaaacgtgaccactgaaattcataggtcatatgaatgccgagcaaaatggtcatagccaagcaaaatgatttccccacaggcattactttctttgttaaaaaatgcttacataaaagaattttaagatttggcagttttctggttagaaatataaattagggaagctacacaataagttttcgttgactcataggttgagaagcagcttccataaattatctagatatttttcccacctctacttaggaatgttctaaactgatttagacagataacttttgtataattgcattgagaaaggtaaccttacagtctatcacctatcccagtgttcagaggttgatgctaggcaagttaatgagatatgcacattttcccaacacattctttcatctcaccatttgtgtgtctcttttataactctcgcaccttgtctttcagcttcctggtggtgcttgaatggaggcaaggagtcatactggggagatagatgcaagggttgcaagtcctgtctaaatctcttactgtacaaactttgccatatcttctttactctttgagcctccttgatcttcaccatataatggtggtaataatatgtaccttttaggactgagttaaatgcacacaaagtcatttttccctcagatgggccatagggtccatgaagaggttaaaattatacctcctttcttaacttcctttctgcttacaaccaaaactgtattgaaattgccagcctggtccattccaagatggccaaacaggaacagctctggtctgcagcccccagagtgatcaacgcagaaaacaggtgatttctgcatttccagctgagcttcctggttcatctcactgggactggttggacagtgggtgcagcccatggagagtgagccaaagcagggtggggcattgcttcacccagggaacacaaggggtcaggggatttccctttcctagccaagggaagccatgacagacggtacctggaaaattgggacactgatgcccaaatactgcgcttttccaatggtcttagcaaacagcacaccaggagattatgtcccacagctggcttggcagatcccatgcccacagagccttgctcactgctagcacagcaatctgagatcaaactgtgaggtggcagcctgttagggagaggggcatctgtcattgctgaggcttgagtaggtaaacgaagtggccaggaagctcgaactggatggagcctatggcagctcaacagggcctgctgcctctgtagactccacctctgggagcagggcatagctgaacaaaaggcagcagaaacttctgcagacttaaacatccctgtctgacagcactgaagacagcagtggttctcccagcatggtgtttgagctctgagaacggacaaactgcctcctcaagtaggtccctaaaccccgtatagcctaactgggagacacctcccagtaggggccaactgacacctcatacaggcaggtgccctccgggatgaagcttccagaggaaggatcaggcagcaatatttgctgttctgcagcctctgctggtgatacctaggcaaacagggtctggagtcgacctccagcaaactccaaaagacctgcagctgagggacctcactgttaaaagaaaactaacaaacagaaaggaatagcatcgacatcaacaaaaaggacatccacaccaaaacctcatctgtaggtcaccatcatcaaagaccaaaggtagataaaaccacaaagatggggagaaaccagagcagaaaagctgaaaattctaaaaaccagagtgcctcttcacctccaaaggattgcagctcctcgccagcaatggaacaaagctggacagagaatgactttgacgagttgagagaagtagtcttccaaaggttggtaataacaaatttctctgagctaaaggaggatgtttgaacccatagcaaggtagctaaaaacactgaaaaaagattagatgaatggctaaccagaataaacagtgtagagaagaccttaaatgacctgatgcagctgaaaacaatggcacaagaactacatgatgtgtgcacaagtttcagtagctgattcgatcaagtgaaggaaaaggtatcagtgattgaagatcgaaatgaagcgagaagagaagtttagagaaaaaagagtaaaacaaaatgaacaaagcctccaagaaatatgggactatgtgaaaagaccaaatctatgtctgattggtgtacctgaaagtgatggggagaatggagccaagtttgaaaacactcttcaggatattatccaggagaacttccccagcctagaaaggcagaccaacattcaaattcaggaaatgcagagaacaccacaaagatactccttgagaagagcaaccccaagacacataattgtcagattcaccaaggttgaaatgaaggaaaaactgttaagggtagcgagagagaaaggtcaggttacccacaaagggaagcccgtcagactaacagctgatctctcagcagaaactctacaagccagaagagagtgggggccaatattcaacactgttaaagaaaagaatcttcaacctagaatttcatatccagccaaactaagcttcataagtgaaggagaaataaaatcctttacagacaagcaaatgctgagagattttgtcaccaccaggcctaccttacaagagctcctgaaggaagcactaaacatggaaaagaacaactggtaccagccactgcaaaaacatgccaaattgtaaagaccatcgatgctaggaagaaactgcatcaactaatgggcaaaataaccagctaacatcacaatgacaggatcaaattcacacataacaatatcaaccttaaatgtaaatgggctaaatgcctcaagtaaaagacacagactggcaaattggataaagaatcaagacccatcagtgtgctgtgttcaggagacccatctcacatgcagagacacacataggctcaaaataaagggatggaggaagatctaccaagcaaatgaaaataaaaaaaaagcaggggttgcaatcctattctctgataaaacagactttaaaccaacaaagatcaaaagagacaaagaaggccattacataatggtaaagggatcaattcaacaagaagagctaactatcctaaatatatatgcaccgaatacaggagcacccagattcataaagcaagtccttagagacctacaaagagacttagactcccacacaataataatgagagactttaacaccccactgtcaacattagacagatcaacaagacagaaagttaacaaggatatgcaggaattgaactcagctctgcaccaagcagacctaatagacatctacagaactctccaccccaagtcaacagaatgtacattcttttcagcaccacaccatacctattaaaaaattgaccacatagttggaagtaaagcactcctcagcaaatgtaaaagaacagaaattataacaaactgtctctcataccacagtgcaatcaaactagaactcaggattaagacactcactcaaaagtgctcaactacatggaaactgaacaaccttctcctgaatgactactgggtaaataacgaaatgaaggcagaaataaagatgttctttgaaaccaatgagaacaaagacataatgtaccagaatctctgggacacatttaaagcagtgtgtagagggaaatttatagcattaaatgcctacaagagaaagcaggaaagatacaaaattgacaccctaacatcacaattaaaagaactagagaagcaagagcaaacaaattgaaaagctagcagaaggcaagaaataactaagatcagagcagaactgaaggagatagagatgcaaaaaaacccttcaaaaaatcaatgaatccaggagctggttttttgaaaggatcaatgaaattgatagactgctagcaagactaataaagaagaaaagacagaagaatcaaatagacgcaataaaaatgataaaggggatatcaccaccaatcccacagagatacaaactaccatcagagaatactataaacacctctatgcaaatatactagaaaatctagaagaaatggataaattcctgtacacatataccctcccaaggctaaaccaggaagaagtccaatctctgaatagaacaataacagactctgaaattgaggcaataattaatagcctgccaaccaaaaaaagtccaggacctgagggattcacagccgaaatctaccaaaggtacaaagaggagctggtaccattccttctgaaactattccaatcaatagaaaaagaaggaatcctccctaactcatttaatgaggccagcatcatcctgataccaaagcctgtcagagacacaacaaaaaaagagaattttagaccagtatccctgatgaacatcaatgcaaaaattgtaaataaaatactggcaaaccgaatccagcagcaagcacatcaaaaagcttatccagcatgatcaagtcagcttcatccctgggatgcaaggctggttcaacatatgcaaatcaataaatgtaatccatcacatatacaaaaccaatgacaaaaaccacatgattacctcaatagatgctgaaaaggccttctacaaatttcatcagcccttcatgctaaaaactctcaataaactgggtattgatgagacgtatctcaaaatagtaagagctatttatgacaaacccacagccaatatcatactgaatgggcaaaaactggaagcattccctttgaaaactggcacaagacagggatgccctctctcactactcctattcaacatagtgttggaagttctggccagggcaatcaggcagaagaaagaaataaagagtattcaattaggaaaagaggaagtcaaattgtccctatatgcagatgacatgattgtatatttagaaaaccgcatggtctcagcccaaaatctccttaagctgataagcaacttcagctaagtctcaggatacaaaatcaatgtgcaaaaatcacaagcattcctatacaccaataataaacaaacagagagccaaatcatgagtgaactcccattcataattgcttcaaagagaataaaatacctaggaatccaacttacgagggatgtgaaggacctcttcaaaaagaactacaaaccactgctcaacaaaataatagaagacacaaacaaatggaagaacattccatgctcatggaagggaagaatcaatatcgtgaaaatggacatacttcccaaagaaatttatagattcaatgccatccccatcaagctaccaatgactttcttcacagaattggaaaaagttaacgttcatatggaaccaaaaaagagcctgcattgccaagacaattctaagcaaaaagaacaaagctggaggcatcacactacctgacttcaaacaatactataagactacagtaaccaaaacagcatggtactggtactaaaacagagatatagaccaatggaacagaacagaagcctcagaaataacaccacacatgtacagccacctgatctttgacaaacctgacaaaaacaagaaatggggaaaggatttgctatttaataaatggtgctgggaaaactggctagccatatgtagaaagctgaaactggatcccttccttacaccttatacaaaagttaagttggattaaagacttaaatgttagacctaaaaccataaaaaccctagaagaaaacctaggcaataccattcaggacataggcatgggcaaggacttaatgactaaatcaccaaatagcaatggcaacaaaagccaaaattgacaaacaggatctaattaaactgaagaacttcttcacagcaaaagaaactaccaacaggcaacctacagaatgggagaacatttttgcaatctacccgtctgacaaagggctaatatccagaatctacaaagaactcaaatttacaagaaaaaaacaaacgaccccatcagaaagtgaacaaaggatatgaacagagacttctcaaaagaagacatttattcagccagcagacacatgaaaaatgctcatcgtccctggccatcagagaaatgcaaatcaaaaccacaatgagataccatctcacaccagttagaatggcaatcattaaaaagtcaggaaacaacagatgctggagaggatgtggagaaataggaacacttttacactgttggtgggagtgtaaactagctcacccgttgtggaagacagtgtggcgattcctcaaggagctagaactagaaataccatttgacccagccatcccattactgggtatatactcaaacgattataaatcatgctgctataaagacacatacacatatatgtttattgcagcactattcacaatagcaaagacttggaaccaacccaaatgtccatcagtgatacactggattaagaaaatgtggcacatatacaccatggaatactacgcagccataaaaaggatgagttcatgttctttgcatggacatggatgaagctggaaactatcattctaaggaaactatcacaaggacagaaaaccaaacacgacatgttctcactcataggtgggaattgaacaatgagaacacttggacacagggcagggaccatcacacattggggcctgtcttggggttgggggctcggggaggggtagcattaggagaaatacctaatgtaaatgatgagttaatgggtgcagcaaaccaacgtggcccatgtatacctgtgtaacaaacctgcacattgtgcacatgtactgtgtaacgtaaagtataataataataaaaaaaaagaaattgccaaccctactcaacagctgttggaaaaaaattatctgtcctaattattttgcctttacatgtgcaggaatgataagtacttaagaacaaatgtgttatctccaggctggagatcttcatttggatatatggtaatttccttaaacttaacatgtccagactgaacttctgatcctccctccccaaccaaacccctatcacaaatacccaattaatatctcttggacagcaactctgctcttctgatcactatgtaaaaactttggagtacctcgttgacacttctttctctcccaccctacttccaattatcaggaaatcttagtgtctgaaactttaaaatatatttcaaatctgattctttattgctacttctaacaactatcatgtcgtaaattttttcattttttgcctggattaggcaataatcatcccagtcacatcccctgattcaactttcttccatctgttactgctttcaagatagatgtcaggaggatcttttcaaaatgttggttcacataactgaaaaccctgtaggggcaccctgcttcactgaggttaaaaaccaatattctgactgtgctctgtaaggccctatatgatcaaaatcttgacctctattcctacctgatctgatctccctcacattttccagctgggtgcctgctttcttgcttcttctataacacattaggttgtgaagcatcctctgtcctcaggttcttcactctgtctgctacctctgtctggaaccccttacccactcctccttccccctaaatccccttggctatctttcttacctctttcctcaaatctttgtcctctcaataggactaacttgaacctgacatttaagattgtgggctgtccccaccccactactacaaatcctccttatcccgctgtacccttttctgaatgcacatatcatcttttcaaattttatataagttacttatttattatttaccatatttttcttatttcttctttctatcagaaagctgtagctgtataaggatggattttttgttgatgtatcccaagtattttgtatggtatctagtaaatagcagacaataaatatttgttgaatgaatggacaacatatgtattattctgttctcatgctgctataaagagctgcctgagactgggtaattgataaaggaaagaggtttaattggttcacattccacatgactgggaaggcctcaggaaacttacaatcatagtggaatgggaagcaaacacgtccttcttcacatgcctgcaggaaggagaagtgctgagcaaagggaggaagccccttataaaacgatcagatcttgtgagaactcactcactgtcttgagaatatcatggggaacctgccccaatgatttagttatctccatctggtcccacccttgacatgtggggattattatgattcaaggtgagatttgggtggagatgcctagccaaaccatatcaacatattaagccttcttgaggtatttgtatgtttaaaaagtttcttactcatctataggaatcagcctccaataacaaactttcatgcggtgtggcagatttctgggagatagcctgaggcttttccactactcctcctattaaacaatttgcatgtctgaaacttcagaattaaaatttgggtcaaaaatatagattggcaaaactattggtatgtttaatgtatatattatgctataaaatatatatacaaacatgagaaactgtttgaagaaattattggggggatgtgattattagtaaaacctcccaaaagacattacagcttagtggttaagatcacaggctctgtatttcagttaaatcttagttatactacttcctagtataagcttgcgtgagttattggagttctctctgcctctgtaaaatctggactttcctacagttgggtaccgcagtaagtttatgatagctgcagggtagaaacataatgagttgtatgcttattatctgcaaaataatatattcagattgtgtgtggaagtttttatttgggggacattaaaagttcttatgtcagacactgaattgtacattaggtgactcttcagtgaccatatttatttaaattgacaaataaatattgtatatatttatggtatacaacacgatgctttaaaatatgtatacatacactgtagaatggctaagtcaggctacataatatatgcattactccacatacttattttttgtggcaagaacacttgaaatctattatattagcgatttccaagtatataatacattgctattaactatggttacaatgttgtatgatatatctcttgaacttattcctcctgtctaactgaaatattgaatactttgataaacatcaaaggatacaatcaacctaccccagtccctggtaactacgattctactccctgctactgtgacttcaactttttaggctacacaaataagtgagatcgtgcactttctgtgtttttctgtgtctgacttatttcacgtagcatgatgtcttccaggtttatcattgttattgcaaatgacaggatttccttccttttaaaggctgactagtatcccattgtgtatttataccacattttctttatttgttcacgtgttttgggtacttagcttgattccatatcttggctgttgtgaacagtgctgcggcaaacatgggagtgccaataattcttcaacatattgatttcatttcctttggatatatacccagtggtgggattgctggattatgtggtagtgatcatgttttagacatgatgataatagtttatatctcctaaggttgttgtaagaaataaaataatgcttataaagtagtcagatcagtgcatggtacctagtttaaatattcagtatttattgaacaaaaggaaagaaaggatgcaaaacaaaatagagcatacaaaaaagttatttaaccaaacacagcactttatggaaaaatatatcaactgttttgttcttgtactaaaatatattttgataatatatgtatcactttatattctttaagatttaaatctatcctatttgttatgcaaagaaagagctaaatataactacattggttcctccactgacgtatatgtgtagacattatttttgttacaacaaagacaatatttactgttggcaagctacacagaaatacatgatgaaggcagaaagaaaatatcaaggaaacaagtcatatccttttaaggacaaagctgttcttgtgaacagtaatacccaacaccacaggatatccgattaacctgtttcaagaaaagttcccatcgttgaaggacatgaagtatatttcacacttaaaagtgtatttgtcttcctatctttaacctcacccttccttttatgttgctttggtttttcaaattctctgtgtatcctcctagaaaaaataaaataaatagaaaaataaaatgaagaaaagaaacccagacacaacatttaaggttaaagagtaaattgtacaaaggaattgaagaaaacaagagagctcttaactcacttcctcaaaggattgaaatttttatttgaagtcatcctatgcattaaaacatcacagatttttattacagtgaataactattgtgaagtgggggaagagaaaggaggaagaagatactatgtttaattctttttattgtggttaacattactgtggtagatgttagtggttgtaaattggatgaaacttatggagggctgctgagttgctggtcaaatttcatctcttgatttatgaggtccttattttgcttcctttgtaatcattacgtataattcatcaatctctacatgaataatttgtatgcttttctttatatctagtatattttaattaaaagttcatatgcaaataaaaaattaaagagagctccaaatgtattaaaaagagcaaataattaaatttcatcctgggctgtattgcagttggttactgcagttagcttgttatagctatgggggagaaacataatacttccttttacctggagatataaaataactaaatttgtgtgtgggagtttatctttttggactacgtgttctgtgtgagccaataaattgtatagtaggtgagtcttcaatgatcatgttttaaagacacattgctcaaatttacattgtccttatttgatcctctataaaagtaagaaaatatcattaaatcttaactcatttgacatcatgctgcaggaagataaggtattaaagtctgggtatatttctttctgttgatttaacattataaggcatagatactgtgatatccaagacaataaatagtaaacatattcattattatctatttttaaaatgtcagttatcttagaagttatctattttccaatgttgtggatattgaggttgatttctctgattaatgtcaaaaatcatctgctatagggaagaagggctgatatcctttaattttttgatagactatatgtaaagatttctctggaaatctaagaaccacacaggaggggacttgaattatactaaaaatcaaactcctttttcaagaagatcaagggaccataaaagagctttgcccagcctggaatacccgtttcctaagtccttatctgtctcaattctttcttgaacatgtctattggtattcaccttctccagaaagttttttggattgcctagctaatgcagctctacatttctatagttcaaacccctagcactacagtttataaacaaaaatatcacaaaggttggtttgcttgtcctcagcacatagtcaataggtgtttggtgagtgaaaaagttgtcagttggggctattgaccttcagaggggaaactgttatacctgcttgctaataatctgaaactgtctagcgttagtagacattctcaatgcctattaattattttaattatttaagagtacgaagaaagaagagaaaaaagaaataaaaaagaaagggaaagggaaaggaaaggaaaaaggaaaaaaagacaatttagttgagcagggttgacaaatctctcaaagcaggtcatggtgcaaattcttgtgtgcctgacacagaaaaataagtagcttactattgaccaatggtaatttcattcttaaattaagacataggcaatgaaacgtagacaataagcatattttctccctttgagttctacatgcatcaaatgaatctttgagggacattccaccaggccaaagtctagactaaacaggtgtaaaaatgagaactattttaatttttaaaaattaagaataggctgcatgaagttacagcagagaaaaggcaaggcaaagaattatatcctaaagtatgaatcacatgtggcttgagtttatccatttttcaagtttaatccctgaattgaactagaattcactgtctattaattttattctaaaatcctcctgtaattttataagccagttttacaagcttttggtttaattcataattgtgtaagaaaattgtggtgctcgaatcatatcaaaaacaaatttaaaccacccaatccaagcaacaaaaaacaaaaagatagagaaggtacagaaagacatagagaaagagactgacaaaaatgggaaagcatctagaattcatgttttgtaggaacttgggctggaaaaagaggactgaagtggaatatgattgataacttcacaaagtaggcacaaattggaagtcaacacaggttggcttcatttcaatattgataactttcaaagcatcagagctgtgcagcaccaggcagaaggacctcatggaggaaggcacactcattactggaaatgttcaaacagggcctgggtgaccacctctctgggtgttggatggccaagacattgagaagacattcgatgaaatttcttctaatttgtagattctatagaatgtagtatcccacaaaggacatgggaaaacacctctctatttctttattctttccttttctcataaccaaatagaattgataaaatgctatcttagaatgaataacagagagtattatgacacatttcataagtagctaaaatctataatactccaaacagaataaatgctaggttcaaatccctaaatcagatggagaaaggaaaatatccaggtcaatcttttataaaatttaaaatgttatatttgatatattgctgattttctaccattttattagctataatggttattacagttataagttttaataggtccatatgtatatatgtatatatatgtatgtatgttctaaaagatgagtttaagtgatgcaggacttattagttccgtagaacatattaaccattgcactattttttatacttattaagtaactaattgtatatcatatggaaaagaaaaaataataagatctaaaaacaggtctaactgtccagagacagaaggagataggtcccacggtgttgacttgtaccttgttagggtgtttcactaagtaatgcatatgggggtgtttgaaatacattttcaattaatttaaaaggtgtttgtgtgcctttaagggatcaaggatagaatggtaaacacactatgttattttttcactaagagtcacagtcagtgggagaaacagataggtgaacctaaaattacagtacgttaagacagacacaataatagaagcacatcgaattgctgcagatcagagaggaggggcatgtattcagaaaggaaagtcaggaaggcttcatggaaaatgtgagattcgagctccaaatttggaagagtgaattcatgtgcgctacatgaagaggaatgaaaggattccagcagtagaataattcagaggtatcaaacagtctgatactgccaggtaactgatgccccaagaaagtgctggaccagtcatgaaatggagagtgaagcaggtgaatggacagctgggagctcaataaaatgagttgctggctggaaggggagggcataaagctgggttgaaataggatggttagaggtaagcctgatataagagtgggttgaagggcagacagaactaatcttctgaatattactttttttatataaagctttctctagtgtgtggctttatggctttatgagtcgtggagtgtcttttgaccagcatcagacacccaggtggcagcctcaaatagcactgcctgtgtcctgctggaaaagccagatgttggcctgttgctttttttgcatgaattttataaaattgcagaaaattctggggaaatggaactttgattagtcatatttttctgcccatggggagaatgtgattttagaagagatgaaagatatgaaatacttgattatatgttgttatttttcatgatatattgatgattatatgcaataataaattaaaaagtaataaggaatcaattctttatttccatgaagagggatcttagctgtgattccataaaggtgggcgggtgtttttagggaggatggttgaggtggatggtagcctctgctcttagttgtcttcttgcctgttgctcatattccctttacttttatttttgtttatttatttaatttataattgatatattatggtcgtacatatttttggggtaagtgtaataatttatacacgtacacaatgtgtattgattaagtcaaggcaattgggatatccctttcagatttactccagggaagatcacctgtgcacatctaattgagacaggtgacctggatggctttgaagttcaccttagcctgactaaactttagccttctttctgacggcagccccagatctctcttttcttagagcattcattcattttagaaaacttgcaaattgtaactatttctgtgctcctttgaaatgaaaatctttaaaaaagcctcttgccagttttgcaatctagaattgtttttctcagggagctgagggtcttccccctccttttttttttttttttgagaccgaatctcgctctgtcgcccaggctggagtgcagtgatgcgatgtcggttcacaccatcctcctgcctcagcctcccgagtagctgggactacaggcgcccaccaccatgcccggctaattttttatattttcagtagagacggggtttcactgtgttagccaggatggtctccacctcctgacctcgtgatccgcccacctcggcctcccaaagtgctgggattacaggcgtgaaccaccgcgcccggccatggtggtggtggggggtggggtgtcggggggtggtcctcctttcgaaatgcaatcatcaagaaagagcccccatctttctggctctgtgtggggataggagcctaacttagataagcaaaaattagcaaacacagatggcctaattgcattgaccaattccccacaaatgcctcctgtactttttccactctctcacctcagcatttaaaagctcttccaactttggtttctgcagaattgagttcaatctctttcccttattgccataaccttggccccaaacgcaataggtgtggaataaatcttccttacctgtttaacttgtccactgcaacttttctttgacatacggtttgcctagaatcacactaaaagatggccacataaatctatagccaaaagagtttcagtataaggtgaaattggccatagtagcacgtgttcgtgctaggtgactggagattttaaaaacctaggtaatcaacgtagtgtctctcttcgagttctatgtgcacaaggtgagtctttgagggatgttccactgggccaaagtctaggccaaaagatcttttaaaaggtgtaaaaatgagaactattgagggcagaatgattagctgtgtgaactgaaagtaaatatagaatactgggatgggactgaaggatggagataattattcttctgcacgttcaaggagttaagttgctgtgattttttttccagaggtaagatggaaaattaagtcatatatgcaacaaatctctttttatgatggtaagtttctttgaacttttttatgccttccaactagtgaagataattggataggttatccaatgattcttatatgacaactttgcttgcaaaaacaaagtgggtcaaaaatgcaaatatagccttctgctttaatgcaaatatgggaaataagcaattatctgacaaatggcagctgtttaaactgcaggatactaaactggtatcttagcaggggtgtcattatctataggccatttaaagtttgtttctttattatttcatttttattggctttggttttaaaaagggaaagataaactccccaactgaaggctttattacttttactatataaatgttgctctatgaccaaaaagatatgctgttatttgattaaagttctcaaaagagtaatctcaacttttttattatttctatttagagataaagaaaatacttgagtgtgtgtgtgtgtttgtgtagcagccaagttgaaacttttatgttgacattattcttgttgaaatttatcttcacaattcatagaaattggtgattgatgagaaattttaatttttttaagtaaaatttggatttgcttagcatctcaggacagaacattcttcatggatagaattctgttctacatggaagtgggcagataaatggggcaaactgtggtggaatggcaaaggaggtaaggttactttccattgctcccgtttactttttttttcatttactcctaagcaccgtctctctctttcatttcaggtattcagtatcctgttaattgtaatccgatctcccctggagagaaaatggtaattactttcaggttcatgaataccaataataccaattgatgtatttacctcattattttctttgatatgacagctacactaatagatcagaacaaaatgtgtccatgtagtatcttgagttcatcaagtcactttgcaagttatctccaatatattgtgggttagctatagcaatataagctagatgctgtagatagattaataatcaaatgtctgcattcatagaatgactactaatgaactgctgtcaacaagaagaaaaaagttcgatcggtgtaagtggtagctgggtcccttttctctttactatgttcttaaatgaacacatacaggcagggtgtggtggctcacacctgtactcccagcactttgggatgctgaggtgggcaattcactcaagctcaggaatttgagaccagcctgggcaacgtggtgaaaccccatctctacaaaaaaatacagaaaattagctgagcatggtggcatgtgcctgtagtcccagctacttgggaggctgtggtcagagaatcacctgagtctatgaggtaaaagctgcaatgagcagagatcaagccactgcactccagcctgggtgacagagtgggaccatgtttaaaaaaaaaaaaaaagaaaattaacatacgaaaaatacttttttttttttttgtatgatgtgcagcctagaaggaaagtgagcagtggcatcaggagccactgaaaaagttatcagactgggaaattgtgttatgcctaataatattacttttattaaggatgaaagtaaaatccgacactggtgaactcaaatcccatgagagtagggacagacatggcacaaagcatggaaaatggaacgagattttaactgaaaatacatttaatatgaatcatcaatcagatatgatcgctatagaggctagtgcaactttggctaaattaatagaaatgtagtttagagaatgagggaggcattatctttctcttttctgtgtgtcaggcaacactttgctgattgcttttagtcctaagtgccacagtttaagggaaaaatgcacaaattgaggacagttaatggaagggtctggggaagaagatgccatgctatagaactttaggaagcactggagctatttaatatgatgaaatgaatgtgcctgtgtgtatctgtgtggttagaagcatgaaatgggtcaaagatggttacctgcattctatttagatctaacaaatagaattaggagaattagaattaaagagtgcatagggctgggtgcagtggctcacacctgtaatcccagcactttgggacacagaagcaggaggatcgctgaaggtgagatcagcctgcataacacagtgaggcccccatctctaaagaaaaaaaatgagccagacatggtggcacatgcctgtagtcccagtgactcaggaggctgaagtggcaggattgtttgtgctcaggaggttgaggctgtagtgagctgtgattacgccactgcactccagcctggggaacaacagagtgagaccctgtatcaaaaacaacaacaatgacaaaaaagcagaatcaaagaacgtactctaaatggggacattcttttgtctaataaatcttaaggccaggcatgttggctcactcctgtaatctcagcactttgggaggccgaggtgggtggatcatctgaggtcaggagttccagaccagcctgaccaatatggtgaaaccccatctctactaaaaatatgacaattagttgcacctgtagtcccagctactcgggaggctgagacaggagaattgcctgaacctgggaagtggaggttgcagtgagccgagatggcgccactgcactccagcctgggtgacagaatgagactccatctcaaaaaaaacaaaacaaaacgaacaaacaaaaaaactgccacaaatcttcaagaaatttcctagctgatttagggtagaacacagttccttatgctggagatgtgagcacacatgtccaaatgattcctgtttacatttccagctagagttgatgttcttttagtaaactttcaaaatctctttttaaaattttttgaaagtttactttcaagatctctttttaaaattttttgaaagtttactttcaaaatctcttttttaaattttttgaaaatttactttcaaaatctcttttttaaattttttgaaagtttactttcaaaatctcttttttaaattttttgaaagtttactaaaagaacatcaactctagctggaaatgtaaacaggaatcatttggagatgtgtgctcacatctccagcataaggaactgtgttctaccctaaatcagctaggaaatttcttaaagatttgtgagggttttttttttttcaaaatctctgtttaagtgaagttacttttttagtaaatgcttttagtaaactttcataacctcttttcttagatgtttctttgcacttctgtaagaaagttcatggcaagagcttgtttaagaatgtttcgggccggggcacggtggctcacgcctgtaatcccagcactttgggaggctgaggcgggcggatcatgaggtcaggaggtcgacaccatcctggcttacatggtgaaaccccatttctactaaaaatacaaaaaattagctgggcgtggtggcgggcgcctgtagtcccagctactcgggaggctgaggcaggagaatggcgtgaacccaggaggcggagcttgcagtgagccgagattgcctcactgcactccacgtggactccagcctgggcaacagtgcgaccctccatctcgaaaaaaaaaaagaatgtttcttctattactggaagtgctgactacatgtcttatgttaaagttgcttaaatgatcatatgatttttattggtagtatttaattacgagttccatttgtcttttctttaatagcctcatttaacctctgtcactacagttgttattgctatcatatgacttgtaagataattccaaatatgtggatagaaagtaaaagttttaatgagtcactaaaagatccatttgatggttctttcatgtttttgtcttgacttgcaactccagaagctgctcaccttcatgattttgtctgaaatctggatgatcttttgcctggataatggtcaacactcaatttggctttgaagagtcaggcccacaatctcaattgtgatatagaggagagcccacatttctactcagatttttgctacaaaaatagaattcgtatctaaaataataaagaattaattgatatctcatataagttgaatcatgcaatatctgtccttctgtgactggcttattttacttagcataactccctctaggttcatctatttcacctatatgatgtatctaagatacttaaacgcatagaagctgaaaataggatgatggttgctagaggttgtcaggaggggaagaatggggaattgttgcttaacaggtataaaatttcaattatgaaagatgaataagttctagaaatcttctgtacaacacagtgactataggtaacaatatggtattagacacagtaatttgttaagaggataaatctcaagttgactgttcttatcacaaaaaaaacaacataaaagacaatgacaaaaacaaaacataaaagaatacaagggcattttgggaggtgatagatatgtttaataacttgatttcagtgatggtatctctggctgcatgaattggtccaaactgatcaaacttgcagtatggtttttctgtatattaattatacctcaataaagctgttaaaaattaattcatgctgatataaactttaaaaaatttgagatgcaattaaaatacaagatttaaagaaatgtgaacactggttgaaaattggtgagaaaacatctaattctgccagtcatctctgtttctcatttatgtcatgctacttctatctagatcagagcaaactcattctgaaactgtcttgattttagcttctgtctttccaggacccatcgccaggagctgctttccacttatagacacaagtggctcactcactcttctaggtgttagctagcaggggcagagctttctcaggtattttagcattcgttgtgttggaaggtctctgctatgttcctgaaaattcattttatcccctttttcctttgctacatagaaagaggaagaaaccgttatgtagattgttctgtgtgaatcctcttatgatttttatcaccataaaacctttatgattttatcaccagcttccctgcagtttcatttcactttttttttttaccttattagtgtgttattgttaatttaaaaataaagagatgactcactcattaaacactgctctgctggtttaatgttcccctagcaatggtcctaaaaggtttccagatcatttacaaacctacatctgattcaatctgattttagttacagtctgagcttattattacatacattttaaagcatatttaaacatagcatcatttgtagtttaaaaacagagatgtaaaataactttgaaaagaggaaactgaagctttgtaatcatgtagatacactacctgaatggcttactgataatttcactttttaagtacattttactaaaattagtccggatgtttttgtttggtttgtaaggtgtataactaagtgtcagttccttaagggagttcagtcctcatggagtttataatcaagtaagagagtcaggtgaaatgatgaaatgaaaacactcatcaaatataaatgacgttctttaaatgcacctctgttagactgactcactgaaatcaaaccttgccattccctagggaacattttctaatttatggccaggacatgctgaatgctcacagctagtagattattttttactaagtctgcagtgaggcacctgcttgccaagaattagttgttggttcccaaacctatttatgacagttgtatttattttggtaataatatattacaagcaaatattatagaaactaacgacattgtgaataaaagagtgtcttatttctatgaagactaagttgaagtctttggaaaggttataataaaggtaataaaaataatcaaattatgtgtgggcaagatgactacaaaagattagagaaaatcttaaattttcaaaaggttatatactctgattattgtaagaatctttagatttccattgtatttaaataaaatactaaagcctaaggattactgcaaataagatgtcttaagacttcaaccagcagattcattctttaattaaaaaaagcctttgttatatataagtacattggcaaatgtatacatttttagataaaataaaaaaattaaaacctatatgtttttgacttatccttttaacaaacttttaaaattaacttactattagctttgcccatgtatgctaagaggacttttacaatgacaagtaagaagaatacattgatgatacctgttttggtccagacatttccagagccatggaatagcatgaaaaaaaaaaaatcttcgaaatataatttattccttcgaattggagtcaaacttagaagcatccatcaatggatgaaaggataaagaaaatatggcatatatagacaatgtaatactattcagtcttaaaaaagaagaaaattctggcgtttgtgacaacatggatgaacatgaaggacattaggttaagtgaaataagccaggcatagaaagacaaatactggctgggcgtggtggctcacacctgtaatcccagcactttgggaggccaaggcgggcagatcacgagatcaggagttcgagaccagcctggccaacatagtgaaaccccgtctctactaaaaactgggcatggtggtgggtgcctgtaatcccagctattcaggaggctcaggcaggagaatcacttgaaactggaaggtggcgcttgcagtgagctgagatcgtgccactgcactctagcccaggcaacaagagcaaaactctgtcaaaaaaaaaaaaaagaaaaagaaagaaagaaagaaaggaagaaagaaagaaagaaagaaagaagaaagaaatataaatactgcatgatctcacttatatgtggaatcaaaaaaagttgaattcatggaagtagagtacaatggtgcttaccagaggctggagggaggtaggtggaatggggagatgttcaaagggtacaaagtttcagttagacaggagggatatgttttagagatttattgcacagcatggtgactgtaattaataatgcattgtgtatttcaaaattgttttaaaatgtagattttaaatgttcttactgcgaaaaacagtatgtgaggtgatagatatgttaattaacttgatttaattattcttatgtaaacctatatcaaaacatcacattgtacctcataaaatatataaaatattactcatcaattaaaaaataggttcaaagagttactgtgaaggctttggttgatagttttcaaagtcttttcataataatgatctcatgtggaatacagaaggactccttcaacagttcacaggaaaacagctgtgtgtttcacagggaggtaggtccttttaagtttgaaatggagttacgttggtggtgggtgatttgttctgaacgtaaatctgggattgttcctagattattaactcctcaatgacagatgttattgtgtttctcttggcaagtggcaaaagtgttaaacgagattcatgagaattccacgtttaagcattattagcttgactcactcaatgtcaccactgtcagctggatacaatgggtaacaccttcttatatggcagtcttgttttgagattgagacaatgcaatagagattaacatgaaagacagaaagtcctatgtacaatgatgtgttttatctgctgggactggggtccggtagacatttgacaacttttgtccacacacagatttcagagaggatgtttctttgttgtgtcctgtcaacatatatgagacaaactgcagattcgtcttaagggagctgaacattaattcattgatagcccacttttttcttccaacctagtgaggcacagtattattgtagggcataataaattcctcttcaaaggttttagcctgtaaattgttaagtacaatgagttctgagatcctctccaaagaaccaatgtatcagtatgttcacctcccctgttctttgttcttcatttgaaagtttaacttcctcattctctttgtctccttgcccctagtttcagcaaacaaccccctcctagcctctatcacctgctccattctgagtcacccctggtcatctgctctgacctgagtcatcctgagtcacctgttctgtaaccgtcctttccactaaactactcaccccaccactccagcttgtacctctgctctctttaaaatagccaatcagagttagcttagactgtgcagtccaaccctagccaataggtgaatgacacagcagtgggggctacctgcgtcagggataagaactccttcccctcccttgttcaggtgtgctttggccattactccattcacgagttgcacccttctatagaagtaaaaattgccttgctgagaaaattaaatttatgtttcagtgctatttcttttgtggcactgaaaatttgtttctcacactattttctctatctagctaaaagaaagagtagtctgaattgtcattactgtacaagggactctgctgcctcttatagctatgtaaagttttactttgccttctgatatgccaattgatgcctaaaagttcttttcatcttatttattaatgattttgtcaaaactacctaaaagtgtagattctaagatatgcagttgtatccattataactagatggatgataaagtctcattaagaaagacaattgaaaacatgctatctggtgtgataaatactttttttttggaggcaagcattagcactgaattctttttaggtctttttagttttttttcttttgctttgtttttgttaaatagtgaaattctgctatacataaagtatatattgtaatatgcctctcttcaggaacctcttgcctacttccttagcatctaaaactatttccaccaaaaagatcaattgagatgagaacattaacttatttagggggatgtatgtcaatgttgctttcataataggtgctactatatactactgcttaggatcatcaaaaagtgaattaataatatcatagttaatatggagttttagattctacctaaaaacaaaacctgtcatttattgagagtttacagtgtgccaggctctagaacctaaatagataatctcatttaacccatgtatcaaccctaaaaggtaggtattatttacaggtaaagaaacagaatcatacaggtgaagtgactcacttaaggtcaaatacattaaaaaaattattattacaatttaaaaagtagatttaggggaatgaatgcatttttgctacatggatatattgtgtagtggtgaagtcttggcttttggtgtacccatcacttgaatagtttacaccacacccagtaggtaatttctcatccctcacacccccaccctcccaccttttgtagtttccaatgtgtattattccaattgtatgtccatgtgtgtacacattgtttagttcccacttacaagggagaatgtgaagtatttgactttctgtttgtgagttatttcacttaaggtaatggcctccaattccatccatgttactgcaaaagacacaatttcttttatggctgagtagtattccattgtgtatatgtaccacattttctttatccagcatccattgatagacacttagattgattccatgactgctgttataaatactgctgcaataaacatacatgtgcaggggtctttttttttttttttttttaattgagacggagtcttgctctgttgccaggctggagtgcagtggtgtgatctcagctcactgcaacctccgcctccttcctcagcctcctgagtagctgggactacaggcatatgccgccacgcccagctaatttttgtatttttagtagagacggggtttcactatgttggccaggatggtgttgatctcttgacctcatgatccacccaccttggcttcccaaagtgctgggattacagcatgagccaccgtgcccggccaggggtctttttaatataatgatttagtttcctttgggtagatacccatagtgggactgctggatcacatggtaattctatttttagttctttgagaaatctccacactgttttccatagggattgaactaatttacgttctcactgacagtgtataagcattcccttttctcctcaacctcaccaatatctgttgttttttgactttttaataggagccattctgagtggtttaagttggtgtctcactgtggttttaatttgtgtttctctgatgagtaatgagtgatgttgagcattttttcatatgtttgttgctgcttgtatgtcttcttttgaaaaatttatgattgtgtcctttgcccactagagtaggaggtccccaggccccaggccatggactggtccatggcctgttaggaatcaggttgcacagcaggaggtgagtggccagcaagcaagtaaagcttcagctctatttacagctgctccccgtcactcacattacctcctgaactccgcctcctgtcagatcagcggtgacattatattctcacaggagtatgaaccctattgtggactgtgcgtgcaaaggaactaggttgtgtgctgcttatgagaatctaatgcctgatgatctgtcactatctcccatcacccacagatggaaccatctcgttgcaggaaaacaagctcagaactcccactgattctacattatggtgagttgtataattgtttcattatacatattacaatgtattaataataaagtgcacactagatgtaatgcacttgaataatccccaaaccatcccctcctgccccagtccatggaaaaattgtcttccacaaaaccagtccctggtgccaaaaaggttggggactactgcactagagaattaacatggatttgaatccaaaactgagtcttaagaatggccttttaacctagtggtttcaatcctggctgtacaggagaattacccaagaccctaggaaaatttccaggtctgggtaacatacgctgaaattatgaattgattttagatgagccacatggttccaacgtgcagtcagggttaaaactacagattaattaatgcctttgattccctcaaattgatgacagataggaaatactgtccactttttcctcctctctgtgtcatcatttcagcaattatgaagagagctgcagtggatgcgtttttctgattcccacgtgtagtctatgccttagaaggagcttgttagcaaattgcacaagtagagcagtagcaaataaatccattgaacataagataacaaaaaccatattatttgaacttcatacttattaacctaagtagatacagtaagtaaaaattttagcaagccagaggctggtatgaacttctatcaattttctaggtgaggattaatttaaaaaatatataaagtctattggtcattgctttaacttaagctaaatcttgcttaaaacatctgctagagaattaacaggaccatcctttctggagctgctcaagatcggctgaaggaagcaaagctacatttcttggtaagagtattaagatgcatcattcctatggttttagagctcagcatatctaatccacaaaagcacctgaataaggaatgtttgattttgcctttctgtcctcaatattctgttatctcaagttgttttcctgatatgttaaaatgctcacgctgttttaacctccactaatagatatgtgaatttgtagaatatacaattttatcctgattttcatgtggagtgaatgctttatctaccacatgagaaatatgcctgacagaattttctcgcttctgctactgcatacttattcatacttactgacttttgtctggtagacttacttgttcctgcttatgaattcagtctgcccagagtttgaacctcatgttgcactgggcagggaataaagagcctttgtcttagggaagaagaaagtgctctttttatgcctcagttccttttttcaggtgtcctgggtgctgctacctggtacctagtggcagaaccccatgccatggttcatgtgggtcccagaaccctgagactaattggaaacccatcatcattctttctttcccttcggttcttacaggctttggatatctgtaagaattcctcaccctaccaccccattcccaacctcattaactagattcatggtccagatgccttctggattccactacccaaatgaacttgcatcatacatgtttttctctgtattactgaccatcttatccagactcttaatacctgcaagggctcccctcccccgaaatacccaccttactaactggattcatagtactagagaacccaaggctgacctgtagggagacaagttttctgataactgtcaactctggcatttttgttgataacattttcaatgctgaggtgacatatgtttaccttgtaaagtagttataatctctggcttctacctacataacataaagggaatagatttctaacagcagcaaagttattataaatttttttattagaaattcctgattattttgtaattaccttttagcccagtgtaattaattttttcattaatttctttgttccaaatcaagagatcaaaagtaaaagaaaaagtaatattaagagtgaagcaacatgacacaaaagatatattaaagtgtaatcaaagcattttaattaaaaatgactttctgaagcctaattttagctttttcatttcaccagaccatgttgtgataattattttagaggccaagtcacaggtgaagtataccaaaaaataccaagtgcttatttaataattcattcagaagtatattaatgtcaaacataaagctcaagtttttctctgtggttctcacctcttaaaaaataaatttatcccaaatgtctgtaaaatcttttctttccaccttattccttgatccaacatagaaaaataagttgcatttttttttggtagaaaatactgtgaaaagccaggtcatataatataaactgaaagtttttgccgcccaagtttttcttagtaatggaatttggtttctgtgtattgcttttcagcacattttatgtttacaacttttggggatttgaaggaaataatacatttatattttccatcatattgtttctcatttcccccccttttctgggaaatttctatgatttcataaatttttaaattattataattattattttggagaagagatgattattgtatgctgacttttgagttcttattttagagatacaatttttaatgcatctgcaaaaattagttaacaaattttaaaagtagtgaatgctttttgccctcttgtttttctgtttttgttttgggggccaattattttcttttgttgggttgcttgtcatcaagagggccttaaagttcccctcagcttgactaaactttagacatgcttcttgcctttaggcctctaaactcacttttcttactgcatttactttagaaaactggcaattataaattatttccctgtccctttgagatgcaaatctttaaaaaagcttcttaggccgggagcggtggctcatgcctgtaattccagcactttgggaggccaaggcaggtggatcacaaggtcaggagttcaagaccagcctggctaacacggtgaaaccccgtctctactaaaaatacaaaaaaattagctggacgtggtggcgggcacctgtagtcccagctactcgggaggctgaggcaggagaatggcatcaacccgagtggcagaggtggcagtgagccgagatcacgtcactgcattccagcctgggtgacagagcaagacttcgtctcaaaaaaaaaaaaaaaaaaaagcttcttatcacttttgcaacccaggactgttcctctccagaacctgggagccatccttttgaaatgtaatcatcaagaaagatagtgcccctatctcccaggctcagtatttggggaagagtctaattctaatggacaccttgctccaagttataaaaccacctcttgtcatgaagatagaacagaatgtttaccttttctctgggtaaggccaattagcaaacacatccctccatcccagctctcctgcaccctttgttttagtaatgtcgagttcagactaagctgagctctctcccttattgcaatatccttgaataaagtcttccttacttgtttaacatgatctggtgctattttcgcattgacaccgttttttaatcagtatattgctttttaaaaccagctttaattgaggtatcacttacataccacaaatagcatttacccaccttcagtgtcaaatttaatgtttttaaataattccccaactttgtgcaggcagcctgcaccacaattcagttttagaacatttttgtcatccccaaacaggtccctttttccaatttacagtgaatctatgatagtcaattatttttatgcttttgtttttctttatatgtctgggaattcttggttgttattttttacttaaatgggaggaggtaatattccaggtacccggtgtggatttcatttgccttgcttcccctaaagaactctcccctgactgggaagtctgattgacagttctctgtaagtgggtagggcttgtcacctggcagggttttcttcaggttgagcaggtgggaagccagctataaagttgtaggactctaaatgctttctgttggtcatcaggactttgtactagcaacatctagtttttcccaggaaaatgttcacttttaacaccaattgttttacctgggatatagaaggaagggtgtgtgtgtgtgtgtgtgtgtgtgtgtgtgtgtgtgagagagagagagagagagagagaaaacatgggtaagaacaggtaagaactggcacaattgttctgaggacataatttcaattacttcacctgttttcagcctaacttcatgctcacaactgatcagttgttgcaccaggaaaatcagctaccacctctatgcatctccctctcacatatatttgatctgagaccttcagatctttcccccactcatttgtttgtttttgttttattttattaatattaattgagcaacaaaaaattgtatttatttttcatggacaacatattgctttgaaatatgtacacattttaaatacatgtatacaatataatgtatgcattgtaaaatggctaaattgagctaatatacataagtattacctcacatactttcattttttttttgtggtgagaacacttaaaatctacttttttggcaactttcaaaattttaaaaaagtcattcaatactctttgttttaccacatcttccagaagtgtgtaaaaatctctagcctgctgatgctgccccctgttttctttactgtcataatttattttttatgtttctttaccataactttaaaattttctcaagaaagtcaggaggcaactgcatgtgctacttaaagaaagaggaaagaaattaaagaattaaagaaattaaattaaagaaagaattaaagaaagaggaaagaaacatgaaaggtggtttgccagtcaagacaggtttattttagagaaaacgaaccagagaggagcttctggccaagttaggtcagaggcacactcttttacagactgagaatttttaaggattcagggtgggagagtttatcagaggcttggactgcttctgtgtccctttgttgtgcttatttgggagggagagttgtgtgtctgttcccatacacttttctgcagctgcaggcatacccccgagtctgcttttagctttcctatttcagtgcatcctgaaaggaaaggaatgtgcttattaaggcccactgttttgctggggcccattgtatgagggaagtttggcagttactcaagagactctcccccacctccctctgtgcccaagctgtcttatctgtgttttactgtctgctctttctggctgcttatagttagaagagaagtgatttccttgaaatgcatgaggctagaaagggagctggaacttaaagtagtggtgtttgtccgagatgacggtgctcctgctctgtcaactaccatcttgaattgcagctcagttttcttctaagaaataataccaaagttggattgtagttatttcaatagagctatctctgtccagtaatatagtggctaggcagtttgctgaaagaatgaataaaatacaaatacatctccttaaaaacatggcagagatgacaagataatacaaaattttagggccaaagtcaaattgaagacagaagcccagggagataagtatagcaatagagttgtttttgtcagaaggggacttgccaaaaccttgatttttctaatctagtggagtatgggatcaaaagaacagaattccctcaaaagacaaagaccagagttcttctaagttgaggagtctgataggagaactccagaaagctgaactcagatggcatttgcctcattctgtgaggaacaagaggaaaatctccctttccaccttccctaccttaaagagattataggaatttagtcttgatgcttcaaagagcgggagtgggatgggaaattcaactgaagagttgtaactctaagccagcatggatttggtgtccaaagatgtatattttggattgtccataaaatcccaaaccataaatttattgtatttcattgattctgtcatgcacttaatcctccctgcccccacattttacatcaaaatgtacccaaggatcaacaatgtcttcaattcaatgaaatattgaactgtaaaatttcctggtggaagcatagacgaaccttctctggagtaatacaacttcatcttcatctcagagaattcacacaaataatttttcaggaaaatgagtagctccctataaacaattactgaccatacaagaaatgaagcatagtaagtgtggtagccagcagaacaaaacagccaggaggaacatattctataaattaattaggctattagaaattgacagattaaaagaggaagaaacttttgataagtatgtttaaataaatgatagacaagtctgagagtatcttcagataggaaattgtatgtataaagacctaacagtttgaaaatgagtcaagtagataacccataaatgatgtgaatttctaaatttacatagtgtttttcatttttcccttaatgatgacaaagtgagatggttatgtttcccattctgtatatttgtggcttcctaaatttatggtacaagatctgaggatttgccttttgaagacaacttttatacatttcatgtatgttagtaatcgtaacgcaatccctctctgtggaaaactttattatttcttattcttctgtggaaaaaaatactttttatattttagggtcatatcttcactatgggctgttttgctcattttttctgtattcttatctacctccgaagtgtgaaaaatggccttgtgacttgttagttgggattctgggagcattgtttcttccataaaggaaatattgttgactaagcataatatagattatactctacctatgttatacattgaccctcaacccactaacctagaaatgtgcacacattgcgtgggaggtgatattcatagctgtgctttgaggatggtgctggttataacataaaccagcaccaccctggttataacataaaaataaaggaggcttcttttcttgggtgttggttttcttcatttgaaactccagccctagaaaactcatgcctttgttcaaaaatgtgagttggtgacacactggctgttaggtagattcagtataggacaattatgcacctgttgtactgctggtgttttagtagcagcattttgcatatgaactatagcatttcaaagaatcattttgatttactttcatttctgactccttttgtacttgaaaataatacaaaaaatgagaaatctctaagaatttgtttttgtcattaaggatatttctacgtattatattttgcagaaataactttttacacaagtctgtttctgtagaggcaaacatctttgtaatcttctttgagttgagggatatgatttgttttcataccttccctgtcagtaactgctccagcataacagtatgagtcaaactcattccctgaaactcttttttttttccttaggcgttgatgggtgaatgtgaaaattgtacatctctgatggctgctaaatctctttgcctttctaaatgacaaggggtaaatggaatttgtttttcccttaatttgacagcatttccttgtcaaagggttccttcttagataattcgataattaggtgacaattacagcagatgtttaaaaaattttctttgggggtttccaaagttttttagacctcaaagtcatgtcatccaccatagccacataaagacaaaaaaagtggctgggagaatgtaggatggatgagctatagctcattagtactatgctttatatccaatcaactgaagccacaaggccaaagattgatactgctgctgacatgaatatctgtgaagatggaataccctaagtcagggtttatcaacagtggtactactgatattttcgactggatgcgtcttcattttgggaagctatcttgtccactgccggatgtttagcagcattgctggcctctaaccaatagattccttcaattgtgacactcaaaaagcttctggactttgccaaatattcccaggggtggggcgaggggacagaaattgtgcctggttgagaaccactgctctatgtcactgtcatcaatcctggtcttatgcaagcttgggaagagagatacagagaggcatcaagaataatagtccatgtgattttagtaggctaggctgagatcgatgacttcgtaaagtgtcagcttcatcttgttttattttttatgctaacaaatttctcgtttcctcctgtagttttctggttcctatgaacagaagcagaattttttcacaacagaaagtgaagcaacgaagttttgagggttgctcctcatttaatggtgagtcaaagaggcagcatagagaggatatatgaaggttaagagctaaggatgtggattctggagccagactgcctagtttggaagccagctccccatgttagctggctgatcttggcaaagcactcaccttccgcttgcctctaccaataacatagggataatgacagagtcagtttaaggagttgtgaggactaaatgagataatatgtataaaatgcttataagagcagttagtgcatagaaatggtagtagataagtattaaaggagataaaaaggtggttttttttccagaagaaaaaggatacttaagttgattaggaattttgttgtctgtaacttcattaacataatcaacccattccaagttaacaagctctttgacaacgactgatttaacgttaccatcatagcagacgtgcatcacaaatgaagtttgatgtgccttaagtgaatccgtgattcttaaaacacaaaaaagtgattacttacagtttcctgatataaaatagttggcccataaatgtaagttagtcctatcctcaaacactattagataaggatttgattgaaaatttgtcttcacttgctataaccatcaaacctgtaccgtatcttagtcttaacccagagatgacaaatacttattaggcactgatgcaggcaggtgagccccgacatggagtttagctcatgagagggcttggttttgcccaggaaagaattcaaggacaagacagaggtagaagaaaacagctactgaagaggcagtgctacagctctagcagtgggttctatggctgctcttgcagggcagggttaccccttaggcagagactagcagctcaggtcagttttgcagtcatatttttatccactcttaattgcatgcagattaaggagtgacttatgcagaaatttctagggagggggtagtacctttaggtcattaggtcactgccacagaagggggtgataaccacggggtgttgccatggcaagagtaaattgacatggcacactattggacatgtctgattgaaagctgctttgcccaggccctgttttagctagtcctcaatctgttccgtgtccaagccccacctctggagtcaaatcccacctcctacctcagccccttgcatgtattaggttagtacaaaggttattgtgttttttgccattaatagcaaaaactgcaattacttttgcaccaacctatagttataagtatctggccaggacatccaagccaaaggagcacagcacacatatatgaaagctagagggggccatcctgcgggaggatcaagtaaagaacacacacaaagaagacttaactaacagtcactcgaatcgtgagtccactgaagttctttttattcagggttagaaacacatagagaaattcagctataacacgaagcaccatttaactgcagcaatataatatttttgcagtttaggtttaaaaaataggtagatatcaagtttttattattttttactattgtaagtacagatacttgggattcatagaactggcaactatgcctggacttctgttggaagcaggaattcatgctgagttccattccttttctaaaagaagttataaaaagcccaagtgaagtcagatattatgtggatatttttttttatagcaacagtaagtaacttccactttaagatcctgatggtggatatgattttaaagtatgaaggaaatacaaaatgtctaaaatatttcagggcttaagggcatgaatgaaaagaatttggtgtgtggtgtgtattgagtcaagtttaggtaaaaaacaaaggcatcaagacctccgcaaggctcttcctgtggcatgaatcacacagtagggagcttacctgggcacctttcttaaaggtatgccacttgtctgtgataggagtgcttgttgggttggcttttgttcagttaatcctctaaaacgatttcaaaggggcttctgaattttttgttttgttttactttttttgagacaggttctcgctctgttgcccaggctggagcgcagtggcatgatctctgctcactgcaacctccacatcctgtgctcaagtgatgctccaaccttggcctcccaagtaactggaaacacaggcgtgtgccaccatgcccaactaatttttgtattttttgtagagacagggtttttgcatgctgtccattctattctcaaactcctgtgctcaagcgattctcctcccaaagtactgggtttacagacctgatatttttaaagacaacagaaaagcataggtttgggagaattaaacgtgtgctaatagaaaagtattacacaattactagtttactaaacaattagctatatacacatttgctatgagttgtactttacaaaattagttgagtctaaaaaacacacgcatgtatgtttatttttctctaaatgaaactaaatatccatgctcccctttcttgctgtcttcaaattagtggaaaattcaacttgagtcattttagtgcacattctctctcttatgatggttatgtattaatccacatatacctctcaggaggtgtgagtttactgggaaaacaggtgaatgcctctaactgtcatcccctcctaaatgccctctgtagattcttgaaggtgaacaatttcactgccgctgtgccaggcagggcatatgggctctgctgagactgggaccctggtgtgcaaggtccagccccaggatccgatattactcttctgtgtcctacatttttctcttacgacatttatcctaacacaagggtgtttttattttctctgtatgcaataccctgctgttaattattacataagtctttatcaatcacactttatagctttaactccccaggttcctaattggttactaaaggtttgttcctcactgcaggctctgaaaatgccatccacactgccagttaccacctatggctgtgctctctaaaatctctcttagctttgtctacccttttctttacactagcggtaagaggttgttatagatagggttgggtttttggcaggaaaagaacagcttccaggctaagaaatacctgaaaaaattcaccctgtgtgccaaagccatttcttttggatgcctccagtgtcaagccagtgtcagagctattgcggcggaagcagccacattcattgcttcatacgttctctggatgatattcaaatgaacaggacaaagcttcatgaagaaaatccagggttcagttttccatttaccaaaaaggcttgaatgacagatgtccacattttcctaatttttctttttgcagtattttattattttctctcaacacgttttttgtttgtttttacttaaatcttcaatctcctatacatttttctcaagggtatagcctagtctatttccttcacttaaaagagtatgaagttggccgggtatggtggctcacccctgtaatcccagcactttgggaggccaaggtgggcagatcacctgaagtcaggagttcgagaccagcctggccaacatggtgaaaccccgtctctactaaaaatacaaaaattagccaggcatggtggtgggtgcctgtagtcccagctactcgggaggccaaagctggagaatcctttgaatccgggaggcagaggttgcagtgagctgaggttgtgccactgcactccagcctgggtggcagagtgagaccctgtctcaaaaaaaaaaaaaaaacccaaaaagtatgaagttgtatgtgtttgatctcttgagtgactacattgcaatgaatgttgaaataggctgctgtttaaatcttaattcacatcccttgcaggggaatgggggtactcattgaattaaagattaaacttataatgaaagactattcacttaacaagtatcacaccagcacaagatgaagcaaaactaggctatttagtttgcaatgtgctcgtcttcgtattagaacacctctacttaaacacaaattattatgctgataaatatcaatcattaaagaggccaccttactttctactatattaagcttattatcttacgtagcacctgaaatacttgaggtcatatttttattgaaacacatatacatgggtttttctttttttattattatactgtaagttccagggtaaatgtgtacaacatcaggtttgatacatatgtatacatgtgccatgttggtgtgctgcacccattaactccacatttacattaggtatatctcctaatgctatccctccccctttcccccaccccatgacaggcccccatgtgtgatgttctccaccctgcatccaaatgttctcattgttcaattcccacctatgagtgagaacatgtcgtgtttggttttctgtccttgcaatagtttgctgagaatgatggtttctatcttcatccatgtccctacaaaggacatgaactcatcattttgtatggctgcatagtattccatggtgtatatgtgccacattttcttaatccagtctatcattgatggacatttgggttggttccaagtctttgctattgtgaacagtgctgcaataaacatacagtgcatgtgtctttatagtagcatgatttataatcctttgggtatatgcccagtaatgggatggctgggtcaagtggtatttctagttctagatccttgaggaatcaccacactgacttccacaatggttgaactagtttacagtcccaccaacagtgtacaagtgttcttatttctccacatcctctccagcacctgttgtgtcctgattttttaatgattgccattctaactggtgtgagatggtatctcattgtggttttgatttgcatttctctgatggccagtgatgatgagcattttttcatgtgtctgttggctgaataaatgtcttcttttgagaagtgtctgttcatatcctttgcccactttttgatggggttgtttgattttttcttataaagtttttaaagttttttgtagattgtgcatattagcgctttgtcagatggatagattgaaaaaattttctcccattctgtaggttgcctattcactctgatggtagtttcttttgctgtgcagaagctatttagtttaattagatctcatttgtctattttggcttttgttgccattgcttttggtgctttagtcttgaagtccttgcccatgcctatgtcctgaatggtattgcctaggttttcttctagggtttttatggttttatgtctaacatttaaatcttttttttattattatactttaagttttagggtacatgtgcacattgtgcaggttagttacatatgtatacatgtgccatgctggtgcgctgcacccactaactcgtcatctagcattaggtatatgtcccaatgctatccctcccccctccccccaacccacaacagtccccagagtgtgatattccccttcctgtgtccatgtgatctcattgttcaatccccacctatgagtgagaatatgtggtgtttggttttttgttcttgcgatagtttactgagaatgatgttttctaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtacaagtgttcctatttctccacatcctctccagcacctgttgtttcctgactttttaatgattgccattctaactggtgtgagatggtatctcattgtggttttgatttgcatttctctgatggccagtgatgatgagcattttttcacatgttttttggctgcataaatgtcttcttttgagaagtgtctgttcatgccctttgcccactttttgatggggttgtttgtttttttcttgtaaatttgtttgagttcattatagattctggatattagccctttgtcagatgagtaggttgtgaaaattttctcccattttgtaggttgcctgttcactctgatggtagtttcttttgctgtgcagaagctctttagtttaattagatcccatttgtcaattttgtcttttgttgccattgcttttggtgttttagacatgaagtgcttgcccatgcctatgtcctgaatgataatgcctaggttttcttctagggtttttatggttttaggtctaacgtttaagtctttaatccatcttgaattgatttttgtataaggtgtaaggaagggatccagtttcagcttgctacatatggctagccagttttcccagcaccatttattaaatagggaatcctttccccattgcttgtttgtttttttcaggtttgtcaaagatcagatagttgtagatatgtggcattatttctgagggctctgttctgttccattgatctatatctctgttttggtaccagtaccatgctgttttggttactgtagccttgtaatatagtttgaagtcagatagtgtgatgcctccagctttgttcttttggcttagtattgacttggtgatgcgggctcttttttggttccatatgaactttaaagtagttttttccagttctgtgaagaaagtcattggtagcttgatggggatggcattgaatctgtaaattaccttgggcagtatggccattttcacaatattgattcttcctacccatgagcatggaatgttcttccatttgtttgtatcctcttttatttccttgagcagtggtttgtagttctccttgaagaagtccttcacatcccttgtaagttggattcctaggtattttattctctttgaagcaattgtgaatgggagttcactcatgatttggctctctgtttgtctgttgctggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaaatgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcataaatatctcttattattttgagatatgtcccatcaatacctaatttactgagagtttttagcatgaagggttgttgaattttgccaaaggctttttctgcatctattgagataatcatgtggtttttgtctttagctctgtttatatgctggattacatttattgatttgcgtatattgaaccagccttgcatcccagggatgaagcccacgtgatcatggtggataagctttttgatgtgctgctgcatttgttttgctagtattttattgagaatttttgcatcaatgttcatcaaggatattggtctaaaattctctttttttgttatgtctctgcctggctttggtatcagaatgatgctggcctcataaaatgagttagggaggattccctctttttctattgattggaatagtttcagaaggaatggtaccagttcctccttgtacctctggtagaattcggctgtgaatccatctggtcctggactgtttttggttggtaagctattgattattgccacaatttcagatccttttattggtctattcagagattcaacttcttcctggtttagtcttgggagagtgtatgtgtcaaggaatttatccgtttcttctagattttctagtttatttgcgtagaggtgtttgtagtattctctgatggtagtttgtatttctgtgggatcggtggtgatatcccctttatcatttttttattgcgtccattcgattcttctctttttctttattagtcttgctggtggtctatcaatcttgttgatcctttcaaaaaaccagctcctggattcattaattttttgaagggttttttgtgtctctatttccttcagttctgctctgattttagttatttcttgccttctgctagcttttgaatgtgtttgctcttgcatttctagttcttttaattgtgatgttagggtgtccataacatttaagtctttaatccatcttgaattaatttttgtataaggtgtaaggaaggggtccagtttcagctttctacgtatggctagccagttttcccagcaccatttattaaatagggaatcctttccccatttcttgtttttgtcaggtttgtctaagatcagatggttgtagatgtgtggtattatttctgagggctctgttctgttcaattggtctagtttgaagtcaggtagcatgatgcctccagctttgttcttttggcttatgattgtcttggcaatgtgggctcttttttggttccacatgaactttaaagtagttttttccaattctgtgaagaaagtcattggtagcttgatggggatggcattgaatctataaattatcttgggcagtatggccattgtcgtgatattgattcttcttatccatgagcatggaatgttcttccatttgtttgtgtcctcttttatttcactgagcagtggtttttagttctccttgaagaggtccttcacatcccttgtaagttggattgctaggtattttattctctttgaagcaattgtgaatgggagttcactcatgatttggctctttgtttgtctattattggtgtataggaatgcttgtgatttttgcacattgtgattttgtatcctgcgactttgctgaagttgcttatcagctttaggagattttgggctgagacgtgaggttttctaaatatagaatcatgtcatctgcaaacagggacaatttgacttcctcttttcctaactgaataccctttatttctttctcctgcctgattgccctggccagaacttccaacactatgttgaataggagtggtgagagagggcattcctgtcttgcgccagttttcaaagggaatgcttccagtttttgcccattcagtatgatattggctgtgggtttgtcataaatagctcttattattttgagatacatcccatcaatacctagtttattgagagtttttagcatgaagggctgttgaattttgtcaaaggccttttctgcatctattgagataatcatgtggtttttgtctttggttctttttatatgctgggttacatttattgatttgcgtatgttgaaccagccttgcatcccagggaagaagccaactagatcgaggtggataagctttttgatgtgctgctggatttggtttgccagcattttattgaggattttcacatcaatgatcatcagggatattggtctaaaattctctttttttgttgtatctctatcaggctttgctatcaggatgatgctggcctcataaaatgagttagggaggattccctctttttctattgtttggaatagtttcagaaggaatggtaccagctcctctttgtacctctggtagaattcagctgtgaatccatctggtcctggactttttttggttggtaggctattgatttttgcctcaatttcagagcctgttattggtctatgcagggattcaacttcttcctggtttaattttgggagggtgtatgtgtcaaggaatttatccatttcttctagattttctagtttatttgcatagaggtgtttatagtattctctgatggtagtttgtatttctgtgggatcggtggtgatatcccctttatcattttttattgtgtctattttattcttctctcttttcttctttgttagtcttgctagcgatctatcaattttgttgatcttttcaaaaaaccagctcctggattcattgattttttgaagggttttttgtgtctctatctccttcagttctgctctgatcttagttatttcttgccttctgctagcttttcaatttgtttgctcttgcttctctagttcttttaattgtgatgttagggtgtcaatttttgatctttcctgctttctcctgtgggcatttagtgctgtaaatttctctctacacactgttttaaatgtgtccccaagattctggtatgttgtgtctttgttctcgttggtttcagagaacatctttatttctgccttcatttcgttatttacccagtgtcattcaggaacaggttgttcagtttccatgtagttgtccagttttgagtttcttaatcctgagttctagtttgattgcactgtggtatgagagacagtttgttatcatttctgttcttttagaattgctgaggagtgctttacttccaattatgtggtcaattttggaataagtgcaatgtggtactgagaagaatgtatattctgttgatttggggtggagagttctgtagaagtctattaggtccatttggtgcagagatgagttcaagtcctgcatatccttgttaactttctgtctcattgatctgtctaatgttgacagtggggtgttaaagtatcccattattattgtgtgggagtctaagtctctttgtaggcctctaaggacttgctttatgaatctgggtgctcctgtagtgggtgcatatatatttaagatggttagctcttcctgttgaattgatccctttaccattatgtaatggccttctttgtctcttttgatctttgttggtttaaaatctgtcttgtcagagactaggattgcaacccctgcttttttttgttttccatttgcttggtagatcttcctccattcctttattttgagcctatgtgtgtctctgcacgtgagatgggtctcctgaatacagcacactgatgggtcttgactgtttatccaatttgccagtctgtgtcttttaattgggagcatttagcccatttacatttaaggttaatattgttatgtgtgaatttgatcctgtcattatgatgttagctggttattttgctcaatagttgatgcagtttcttcctagcatcgatggtctttacaatttggtatgtttttggagtggctggtactggttgttcttttccatgtttagtgcttccttcaggagctcttgtaaggcaggcctggtggtgacaaaatctctcagcatttgcttgtctgtaaaggattttatttctccttcagttatgaagcttagtttggctggatatgaaattctgggttgaaaattcttttctttaagaatgttgaatattggcccccactctcttctggcttgtagagtttctgccgagagatccactgttagtctgatgggcttccctttgtgggtaacctgacttttctctctggctgcccttaacattttttccttcatttcaaccttggtgaatctgacaagtatgtgtcttgaggttgctcttcttgaggagtacctttgtggcattctctgaatttcctgaatttgaatgttggcctgcctttataggtcggggaagtaagttctcccggataatatcctgaagagtgttttccaacttagttccattctccctgtgaatttcaggtacaccaatgacatgtagatttggtcttttcacatagtcccatatttcatggaggctttgttcatttctttttactcttttttctctaaacttctcttctagcttcatttcattcatttgatcttcaatcactgataccctttcttcaacttgatcaaattggctactgaagctcgtgcatgcatcacatagttttcatgccattgtttccagctccatgaggaaggtcttcactactctgtttattctagttagccattcgtctaatcttctttcaaggtttttagcttctttccgatgggttcgaacatcctcctttagcttggataagtttgttattactgatcttttgaagcctacttctgtcaactcgtcaaagtcattcaccatgcagcttggtttcattgctggtgaggagctgcattcctttggaggagaagaggtgctctgatttttagaatttttcagtttttctgctctggtttctccccatctttgtggttttatctacctttggtctttgatgatggtgacctatagatagggttttggtgtggatgtcctttttgttgatgttgatgctattcctttctgtttgttagttttccttctgacagtcaggaccctcagctacaggtctgttggagtttgctggaggtccactccagaccctgtttgcctgggtatcaccagcggaggctgcagaacagcaaatattgcagaacagcaaatgttgctctctgatccttcctctggaagctttgtctcagaagggcacctggctgtatgaggtggcagttggcccatactgggaggtatctcccagttaggctacttggtggtcagggacccacttgaggaggcagtctgtgtgttctcagatctcaaactccataatggaagaaacactactctcttcaaagctgtcagacagggacgtttaagtctgcagaagtttctgctgccttttgttcagctatgccctgccccgagaggtggagtctacagaggcaggcaagcctccttgagctgcggtgggcttcaactagtttgagcttcctggccgctttgtttacctactcaagcctcagcaatggcagattccccttccgcagcctcactgttgccttgcagtttgatcttggactgctgtggtagcagtgagcaaggctccgtgggcatgagatctgccaagccagctgtgggatataatctcctggtgtgccattttctaagaccattggaaaagcacagtattagggtgggagtgtcccgattttccaggtaccatctgtcacggcttcctttggctaggaaatggaattctccaaccccttgcacttcctgggtgaggcaatgccctgccctgcttcggctcacactccatgggctgcatccactgtccaacaagtcccagtgagatgaacctggtacctcagttggaaatgcggaaatcacccgtcttctgcgtggctcactctgggagctatagattggagctgttcctatttggccatcttggagggatctcaggtttttctgtttaaaataaaaggtggtcatagtcttcagagtgtatatttggaataaaatgtattgaatctggaaaacattatttaatgaaaaattaatatcatttaagcatagaaacaaattttatatatacttgttgaattaatgccttcagaatctaagaaaacctcatttagttggtacatcctctttagtttctgtttatcttgagtttactgattttgtcctaaacagaatgaaatatcattatctgaagtatataaaaccacatctttaaaaaatgaaactgaactatcatttcaaaatattttatagtcttcacttaaaccattgattgagaatcaacaggttttttaaggcaacaactatgaatatttttaaatctttggagactcagtggtttgagttttcatagataatatgattaatctggattctgatttaagacaatcttactttaagggcaaattaagaatctttctactgaagaccacctgaccatctggaatatttttactgctgtcaggtaaatcaccttcaaaatgaggactggattttgttaaaaagggatgacttctgactgcaaaccctctcttaagaacattttgttttctttttcctgataaagtccattttgtaactctcttaaggacatttcataagcaatagcacatggcctccttttgagtactgctctaaggatggttcaatgagacttttgatgacaattaggttgatgcctagaattcacagtgagaggaagttctaatacattttgaaattcccaagatatgttcttgactgcctttaggcacctgaaattattacataagatttactacttcatctaatatgaagatatttggtgcatttgtagaacttttgaaggtgcttttgtctccagtatcattattcatggatcaaggattttaaataatgcgaattgagtgaatcaacagtcatgctgctgtgtgtgcttcgggcaatcctctgtttggcagatttttagatgtcatccaaagcagctcaccagcagcaccttttaattgaaccccattggcacccaccatgacccaagaaaatgccttggctaatgagattacatcatactgtgttagagaacttacagtatcaaattcccatataaatgcaaactataacatctgtgtaaaagtagatagtcagaatttaaatatttcttcatatatgctggcctttgcactgtctgcaattctctgttcccaggcacaaaatctattagaattgcatacaggaactattgcctcctctcttgtatgatttttgttgattttgataaggttcgtatgatttttccaaaccatacaatgatttggaagcttgggggagatctctcatgatattctttccctctccaccataagacttggcacgtggttgccattcagtaagtagtgaccaaagagtagaataaagagcttttccaaggaagcaagtttcaccaattcaatacattggaaagcaagaattgtatcttttgcttcaaatttttaaaaagttttaaataattttcaacacctactcaaactttggctatctcacaatactattatttcattgagcagtcattagatagtttttaagcatctactatattgcaagccccttgccagtttccccaagtacgaagatgagtggcatgtgatctctgaatgcaaagctctctgaccaatagggaaaagacacatgaaaaccattatagagtgagctatgtgtgctatggtgcaatagcacacacagtgctataggtttgcagaggagagtgtattaaatggttcttggccttgtggatagggatgaaccagatggtgagggataacttaagacagattctttggtgaaggatgttgaagaatgttccaggtggacaagggaatgatcctccaggcagataaagtggcttttatagaggtacaggggattgaaagtcctatttggaattgaagcatttgaatgggttgtgagaaggtgctgctggaaagaacagcttcatcgtgatagattttatatgttgtagtacatttggagttatttttacaggcagtgaacaaggcttcatattaattttgcaggtccattatgtgcaaatttccttgaaggcttaagtgaagatatttatgtaggtatgtatgtatgtattgagatggagtcttgctctgttgtctaggctggagtgcagtggtgcgatcttggctcactgcaacttccgcctcccaggttcaagcaattcttctgcctcagcctcctgagtagctgggattacaggcacacatcaccatgcccagctaattttttgtatttttagtagagacagggtttcactatgttggtcaggctggtctcaaactcctgacctcgtgatctgcccacctcggcctccaaaagtgctaggattacaggcgtgagcaaacatgcccggccaatatgtttatttttaacaatgtacttcagaatgagataatctgggattatgtatttaagtttatgtattttcagactacacaaataatggatagattacgaatttcacaatatttctggtctttcagagtgtacatgaaaagactttctttaaatctaagaattgcatgcttttctgaaaaatataagttatgtgagccatgaacttttatattataactactgcagatgttgtgagcatatatgctagatgttagtgtggtaattgaaaagtaatttaggtaaaaataaacatttcattcatttacaaactttatgagaacactgattttatcttatttagatcaaatatatgttcttttcaatatggtgaaaatacaacagggatcataatcaaactcctttttgtacttttaaaggctgtaaatcagaaaaggttaaaggaattcatagtttttctcctttgtttgccaaggttgctgttgatatttactccaaagtggccaatagaactaatgtcatataaagtttcagagtttactgtctttttgcctttggactcaatcagagtgttgtactttctgtttatttgctttgctcttatttatttttaataagtttattgggacgtaatcctcataacattcaattcaccaacttaaattgtataatttgatgttttaaaatatattcatagagttgtacaatcatcactagaataaattttagaatattctgccaccctaaaaagaaacctcatatccattaccagtcactcctcactcacctctattcttacccacttcctcatccctaggcaacaactaacctatttcctgtatctatagatttgattctggatgtttcatataaagacagtcatacaacatatagtcttttggctcctctcacttagcataatattttcaaggttcatttatgttgtggtgcatatcaacacttcattcctctttgtggctgaataatatcctattataagactataccactttattcgtttgtcagttaatagagtggcaaagtggattgttttcacattttgggtattacaaattatgctactatgaacatttgtgtatgaatttttgtgtggatatatgttttgttgatcttgactatacacttaggaatggaacttttgggtcatatggtaactccctgtttagtattttgagaagctgccaaactgttttccaaagtggttggatttgatttattttaacattatcttacatctactttgaataagaatttgagtcaacttgatacagatacttgagtttggcattgtgtgtcctctctgagccttcaagacaatcacattttttcagcttactctgtgtgttctgcataagacagatgattagaataattggagggcttgtcttgtcctatgtgctggaatttggctctctgtgactttcattacaaggtggtgctttagttacttgaggtcttgccagtccttatttccttagtgtgttcagctgccttcaggtagtgagagttagctctatccaagcaaggatttcaggctgagaaaatgaagtttgttcatataaggccacacatgcattgattcttccctgtaaacttacaagttaaggatgattcattgacaagtgtgggaatcctgggatagtctacggcttgatttgtctgtgtagtatggtgccatatgaatagatgtacaaaaattgggggttattgataagtgtgtcaaatacctgagattagagctaaagataagagacccatgtgctgtagatcaccacaccctgagcagtggagagcatgcaggagaactttctctcgactgaataaaatctgtgcagcgatgagggaggcggacggaacagtgatgtgtgttatgcactgaagtgtaacagagactagctgccttgagcaatctggagagctctgaaacattggaaataatttttcttgatataccacaaagacctctgcaggctttgatacctaaaaacctctgcaggtccagtgtggaaaacttctccctctcatgcaatcctctgaacaacatgaggcattagagacctggtgatagctgtcctacacagctaataaaagccacgtggggctactactataatcaggagctgctgatgggaacaactagcttctagggagaacattctctaaaactgcctctagtatcaatttggaaagaactaattttctatggtgtctcctagcctctgacaactgaggatgagtagcttgaagaaaaaagtggccaactccttcttgtaattgccaacctcacatttgactgttattttatttcttgtctttttttttgtatactaagaatagtttataatttctttccaaaaaatatgcatagattctggtcctcccggagagacctggtgttattaaccaactctcagacgtctggtgataagtacagttcagaaggaaaatactatataaaaatatagtttctatctcaaaactctaaaacttatttaaatccttttagaaattataaagtaacaattcaaaaaacaaggaatagagaaaaatttctcacacttacaagtatttttgttctacattgattgatatgtttgttatattgcagcttcttgtaacattttgtctagccatgttgctgccaaaaatggtctttctttataatgaggaaaaatagctttctattatagagcattattgcctcgtattataattagcagggagattatgggatttggagtttgtcagatctgagttggaattccattccagcacagattaattttggagcttgaacaagatgcttatcttctttaaaccacactttcaacagtttataaacatggataatacctatcttgggaaaatttcatctgatggagcatgttactctggtggccaagagttttatttgtttttcatctagaatcatcagctaggaagcctaatttttaaaatcaatgtttgtttagagcagcggtcctcaatttggaatgacttcatttctgaaggtacaattggcaaaacctggagacatttttggttgtcacgtcttggtggcgggggtgctgctgtgccattgaaatctagtggggtagaggccagggatgctgctacatattctatgatgcacaggatcactccctccctacccttaacaaagacttatctggccctatatttcaatagtgctgaacttgagaaacctggtttagaggaaggaaacaaaaatgttcccactatgaggactccttcataaaggaaaaaatattgatgtggcaaatatcactcttaagagattatggtgaggaacaagagaattgcaacatgtaaatattgggttttaagtatttaaaccattggaggaagataagaattgctaatattcaagagtataaaaacttctggaaagatatgttctgaaaatgtacttatgtgaagtgaagcttgaccctatatatgtcgttatgagtggagaaacgcaaagcaaaacagcagtttagaagccatgtaagactgcgtttcagtcccatctccaatgcttgttatctgtgtgaccttggaggggtgactaaacctgtctgagccttggtcccttcactctaaagtataagtaataatacttgccttcaaagatggtgaattttctatttcttttcttttttttctttttagacagagtctcactctgtcgcacaggctggagcgcagtggcatgatttcggctcactgtagcctctgcctcccgggttcaagcgattctcccacctcagcctcccgagtagcagggattacgtgtgcgtgccacgatacccagctaattttttatttttagtagagacggagttttgccatgttagccaggtcggtctcgaactcctgacttcaggtggtccgcctgcctcgacctcccaaagtgctgggattataggcgtgagccaccacacccaacctgaattttctatttctattaggattaacgagatgataaagtgtctaaaacattgtatgggatcaatcaatttcagtttttgttcccatgatgaagtttgggaattagagttgtagatatgaaagttatttttaacaataacttttataaattatgggaagaaaatggcagaggatagcagaaccagctattaagattctgtatgaatttttagatttaaataattttactggcttatttgtgcacatggcacacacaaaaagaacaaattacattcagtaaagagcaagtctacctcctactctttccatttgtctcctgattcttttgccggtggcaatttctgtttccagcttcttatgtattcttccatgagaggaatccttgatattctggcccaaaattgagggaagtgtacagtctttaggaggccctgtggaccaagggcaaggaaactcaggtcagagaaagaccaaatttataggtctggatttcagggagtaaaactgacagtcctgaacaggaaccaggataaagaccaaattttaggtctggatttcagggagtaaaactgacagtcctgaacaggaaccaggataaagacaaaatataatggaggaaagagcatttctagaagacaggcattaggttatcagcttagctgttggaagagggaggggaaaaactttagagacaaaaattacatccagaagccaaagaattgtctgtggttcaaaaaagaatataatatcagcaacggctaggctgaagatggagcataatagaacaaaaagaaaaggttactctcagggcctgggtttgcattaaaatgaaataatacgtcaggcgcagtggctcatgcctgtaatcccagcactttaggaggccgaggtgggtggatcacctgaggtcaggagttcaagaccagcctgaccaacatgaaacgccctctctactaaaaatacaaaaaattagccagccatggtggcatgcacccgtaattctagctacttgggaggctgaagcaggaaaattgctgagcccaggaagcaggggttgcagtgagccgagattgcaccattgcactccagcctgggcaacaagaatgaaactccatctcaaagaaaaaaaaaaaaataataatattcatgagtatgaagggaaaaattaatgactttgtacatctgccaagccagctgaggagtttgaaaatgtatttgggatttaccctaagagtatataatgaatatcctgaaatgtctgtggatgatactgatattgaactatggttagacagcagttgccagagcagggaaggtgatagaaacagagaaaatttaaaaagtcttcccctctatgcccatagctgatagcagagaagagtaatcctgagactcaccaaggatggaaatgatatggcccccaccctgccagccttagcttcacaaactagaggacccttgatagcataggagaacctgtgtggattcacgagaatgacttactattgagattctgcaagtgaaagcatgagatggacttgatttttttttttttttagatgtgggatcttgttatgttacccaggctggagagcagtggctattcacaggtgtgatcggcacactatgacctggaactcctggcctcaagtgaccctcctgcctcagcctctcaagcagctgggactacaggctcctgacaccatatccagctgaacctgattttatattccagtggctgacaaactatttaactcctctgaactacagattctacccacctaatttttgccagtttgtatgcaaaagaacaacttatcactttttattttcaagccacttccctccagccatgtacattaaacccatttcaaaataaactttgtcaagaaagcttacctactttctagactctagatcaaagatgtttcccctcaacttccaggcttgaaatctgttattttcactcgtcttgttgcttcaattctttccttcctccaaatgtaatttgttaatcctttcttcacaatacttttctcattcattgctacaatgtagctcctacaacttatgcaaaatcctataaccttcatgcttgaactgtcttaatagcccctttgttggcattctgcctgcatccacatctttctcctccagtccactgtctacctcagtctgttacacacagtttgtgtctatagtgacattactcctttttcatgaaatatgtctacctgctttgttcagctagtgatatcatattcaatcttttggcaacccccctcctctgagtgacctaccttatctccccaggcagatttgatgcctgcctcaatatccaatatcttaccaatgtcctaccactatataccctgttgatatggcagtgaggttcatacacatattttgtatatgtgtatactaatactatagtttatacctgtaaaactaagatgattatttcttatgtggtatgataaggtatggtatggtaaggtaaggcataaaataaatataatgttatttatctgttatctatttttcacactaagctatgagcacctggaaggtaaggaccatgtatttttaacttggtactcaaaaaccatggtatggtacattatacatgtacacaataaaaaattatgtgatctggtttaaggtgacagactagatgcagctgggatgtgccttttccatgcacagaaaccaaaatatcaagtgatatggtttggctgtgtcctcacctaaatctcatcttgaattcccatgtgttgggggagggacccagggagaggtaattgaatcatgcgggggcaggtctttaccgctgttctcacggtagtgaataaatcacatgagatcttatggttttaaaaagagaagttaccctgcacaactctctctttgcctgttgccatccatgtaagacgtgacttactcctccttgccttctgccctgaatgtgaggcctccccagccatgtggaactgtaattccattaaacctccatttcttccgagtctcaggtatgtctttgtctttatcagcagcatgaaaacagactaaaacatcaaataaaccatagttgggaaagatcttttgagagaaaatactaaaactcaatacagaggaaatggaagacactgtgattgaagagggaagaagtggggttgcctgctaggcaagaactggacccctggataaaaggaaggggtgaatgaaggagccctggggcactgtgttccttccctctgagatcctagatacaagagagttccaagacccgtaaaggtctttctggctgggggagctccctggaaaccacagagatgctgcttgaactttcatggagtacaaaatgcttcagtgtgctgggcagctgcagcaaaatgtgactctgggcaccaacccctgctctgtgtctgaccccaagcagctgctactgctgctctctgccatattggggagtgaatggggcctgggcatgctcatgtgccctaaagacaagctctacttccattgccataggactgaagtgcatccaagtcacatgccccatgtctgctgttccttcctaagactgcctgcctggctgttctcatacaggatgacccacagtgtagctgccattgctccccctccctgaactcagtgttttgttggtggtctgggagcagttcactcctccctatttcagccagagcttgagccagaggggcctgaagacaagtcagctggcctagtcccagttccccaggacttgagcacactgactaggggcttgaggatgaaatatgtggtctgatttcaagtcagggaggagctcccactgtcagaatactaagagtgtggcacaggttcatgtggtacgggagctggtacctctgcctctgcaagactggaccaggaagggtgtggctaggtagtcacggtttttgcctcaggaagtcttgtggtccggaatacctggagtggcttggtgatttgggtgtgaaaatgtggaactagcctactcatctggccagctgctagggctggatcctggaaaaagaccctccaggtcaggaatgtgggagctgggcaggcctcatggccaccttttgggctgaaaaccctgactagcccctcttcctctgagtggactctgtggcacaggagaggcacttttgcccctgcccctacctggagggttgtcccagtggcctgagagctggttctagccattgccaaggttggtgcttgcgtccaccttggagaacttggtcatgggcttgcccaccccagtcctacccaggtttgccccttacagtagccttggcagcagagcttggggcaggacacctgggagctctatgtcctgcccatcacctgggaccccacagaacttccccgattaacaaaggccatgcataaattccactgccatcacaattgcctcttccctacaagttccacctctaggccgggtgatgaactgcatgtcccatcacagctttccttgatatcattgtacagctctcagctggctcttacccacaatcaccacctgctggcctgtagagtgaactgcacaacccaatataatttctgctgccagaagtacacagcactgggggagaagatgagtctcctgagacctccacctctccatgtctgtaggagatagtgaacctgaccacacacacagcctaccgctcccataacctaaaaacaacaagcatttgagaaaactactataggatctctataactaaggagtttatatggagccttggccccctaaaagcacaaagaaacaaagtcaaaggactttacccagcacatgcaacagtcacatcctcaaggggaaaaatagcactcaaatgaaagtaaattcaaaaataatgagtgacagcttatccaaacgagaaggaatcagtataagaactccaacaccatgtagaaacagaatgctgtgacatcttcaaaggaccacattaactctctagcaatagattcaaaccaaaatgaaaattctgaaatgacagatcaaaaatgcaaagtatgaattgtaaagaagctcattgaaatccaagagaaagttgaaaaccaacgcaaagaaatcagaaaaacaattcaggatataaaaaatgagatagacatatttttaaaaaatcttatagaatgaaaatttcactgaaggacgtccaaaatacagttgaaagggctaacaatagactagaccaagcagaagaaaaaatttcagagcttacagaccagactttcaaacccagtctcagaaaaataaaggaaacataatttagaaaaaatgaacaaaacctttaagaaacatgaaccatgtaaaacatgtaaatctacaacttataggcattcctgagggagaaaaagaaaaagcaagaaatttggaagacatatttgaggcaataattgaagaaaatttccctgatcttactagagatgtagatatccacatgcaagaaattcagaaaacaactagaagatgccatacaaggcaaacatccccaaggcatatagttaccagactttccaaggtcaatattaaagaaaaaataatttaaaaggagctagggagaagcatcaaattacctataaaggaaatcccatcagactaataacagacttctcagtgaaattttactagccagaagagattgggggcctatttttagccttcttaaagaataaaaatgccacccaggaatttgatatcctgccaaactaagcttcgtaaaaaaaggagacgtagagtctttctcagacaagcaaacacaaatgaaattcatcatcactagaccagacctacaagaaatactcaaaggaattctaaacatagaaacaatgatactgaccataataaaatcacatataaatacaaagcacatagactctataaagcaattatgcaagtgagactacaaaacaactagacaacaataccatgagaggaacaaaccctgaaatatcaatattaaccttgaatgtaaatggcctaagtgctccacttgaaagatgcagaccagcaaattggataaaaaagcaaacccaaccatttattgcccacaagagactcaactaataggtatagatacagactcaaagttaaagaatgaaaaataagtgggagtagttactttcatatcagataaaacagactttaaatcagcaacagcaaaaaaaaaaagaaggtcataatataatgataaagagttcaattcaacaggaagatttaacaatcctaaatatatatgcacccaatatcagagcacccagattcataaaacaaatactgataaacttaagaaaagagattgacagcaatacaatactaatgtggaacttcaacacccccactgatagtactagacacataattggggcagaaaatcaacaaagaaactttggacttaaactggactcaaggccaagcggacctaacagacatttacagaatattccacccaataaatgcagaatatacatttttttcttctgcacatgtaacattttccaaaatactccatatccttggtaataaagcaagtctcaataaattaaaaaattgaataatatcaagtatcttcttgtacaacagtgaagtaaaattagaaatcaataccaagaggaactcttgaaattacatgagtacatggaaactaaacaacttgctcctgattggcttttgggcaaacaataaaattacagcagagaccaaaaaagttcttaagtgaatgaagatagagacacaacatgccaaaacctatgagatacagcacaagcagggctaagaggaaagcttacggcattaaatgtctacataaaacatacagagaattctcaaataaactacttactgtcacaccttaagggactagaaaaacaaaaataaaccaaacctaaagtaagcagaagaaaagaaataacaaagatctggtcagaagtaaatgagattgagacaaaaaatacaaaggattaaagaaataaaaagttggttctttgaaaggacaaagaaaatggaaagactgttggctagattaacagaaaagagagagaagattcaaataagcacagtcagaaatgataaaggtgacatataatttatacacagaagtacaaaagattatcagagactacttcaagcatatctatacacacaaactagaaaaactagaagaaatggataaattcctggaaacatacaatcttccaagattaaaccaggaagaaatagaaattttgagcagaccgatagagagtaattaaactgaattagtaataaaaaatcttccaacaacaacaaaaaaacccaggatcccagatggattcacagccaaattctaccagatgtacaaagaaaagctggtacctatgttactgaaactattccaaaaagtcaggaaggagggatttctccctaatgcattgtatgaaaccaatatcaccctgataacaaaatcaggcaagcgcacaacaaaagaagaaatctacaggcctatattcctgatgatcatagatgaaaaaatcctcaacgaaatactagcaaacaaaatccaatggcacataaaaaagataatatatcacaatgaagtggattttattctagggatgcaaggatggttcaacatacacaaattaataaatgtgattcaccacataaacagaattaaaaacagaaaccatatgatcatctcaatagatgtagaaaaagcattaaataaaattcaatatctcttcataattaaaaccccctatcaaactaggcaccaaaggaacatacctcaaaataataagatctatctatgacaaacccacagacagtatcacgctgaatgaggaaaagttgaaagtattccccctaaggactggagcaagacaatgatgctcactcttaccattcctatttgacacagtactggaagtcctaaccagagcaatcaggcaggagaaagaaatagcgggcatccagattggaaaagaggaagtcaaatcatctctgtttgctaatgatgtaactgttttaccaagaaaaccctaaacactcttccaaaatactcctagacctgataaatgacttcagcaaagtttcagggtacaaaatcaatgcataaacatcagttacatttctatacaccaataacattgatgctgagaatcaaattaaaaactcaatcccatttatagtagccataaaaatgcatagaaatacatttaaccaaggagttgaaagatctctacaaggagaactataaaacactgatgaaaaaaaaaatgtcagtgacagaaattaagggaaaaaaacccgatgttcatggatggaaagaatcaatattattaaaaatgatcatactaccccaaacagtccacagcttcaatgcagttcctgtaaaattaccaagttcatttttcacagaattagaaaaaacaatcttaaagttcatacagaatgaaaaaacaaaaaacaaaacaaaaaaagagcccacatagccaaagcaatcctaagcaaaaagaacaagcttggaggtatcacattacttcaaattacagtacaagactatggtaactaaaacagcatggcaccagtatgaaaatattaataaatacatagatcaatggaacagaatacagaacaaagaagtaaaaccacatacctaaaacaaactgatcttagaccaagttgacaaaaatcaacaatgggcggaaaggatatcctattcaataaataatgttaggaagactggctagctatatgcagaaaaatggtactttctcacagtatacaaaaattaactcaagatgtattaaaaatctaaacatgaggcctgaaactataaaaatcctagaagataacctaggaaaaactcttctggacataggcttaagaaaagaatttatgactaagacctcaaaagcaaatgctactgaaacaaaaatagacaaatgagacttaattaaaagcttctgcacaacaaaagaaacaatcaacagagtaaacatatagcctatagaaggggagaaaatatttgcaaattatgcatctgatgaatgactaatattcaaaatcttcaaggatctcaaactcaacaagaaaaattcaaataaccccattaaaaaatagacaggctggatgtggcagctctcatgcttgtaatcccagcactttgggaggccaagtggccaaagtgggcagactgctcaagcccaggagttcgagaccagcctgggtagcatggtgaaaccctgtctctactaaaaatcaaaatattagccaggtgtgtgatgggcacctgtggtcccagatactttggaggctgaggtggaaagatcgcttgagcctgggaggtgcaggttgcagggagctgagattgtgccaccgcattccagcctgagtgacagagacccgtctcaaaagaaaaaaaaaaagtgggcaaaggacataaatagacatttcacaaaagaagatatacaagtgagcaacaaacatgagaaaattctcaacatcactaatcagagagatgcaaattataccacaatgatatactatcttacatcagtcagaatggctattattaacattattattgttttaacttttttcttaagttcaggagtacatgtgcagatttgttaggtaggtaaactcatgtcatgtgggtttgttgtaaagattatttcatcacccacgtattaggcctattactcattagttattttttctgatcttttccctccttccaccctctaccctcaagtaggctgcagtatctgttgttcccctctatgtgtccatgtgttctcatcatttggctcccacctataagtaagaacatgtggtatttggttttctgttcctgcactagtttactaaggataatggcctccagcttcatccacgttcttggcaaaagatgtgatctcattcttttttgtagctgcatagtgttccattgtgtatacataccacattttctttatccagtctgtcattgatggaaatctaggttgattccatgtctttgctgttgtgaatagtgctgcagtgaacatttgtgtgcatgtgtctttaccgtagaatgattcatagtcctttgggtatatacccaataatgggattgctggatcaaatgtagttctgtttttagctctttgaggaatcaccatattgctttccacaacggttgaatcaatttacactccaaccaacagtgtataagtggcatatatttctccacaacctggccagcacctgttattttttgactttttaataacagtcattcttacttgcgtgagatagtatctcgtggttttgactttcatttccctaataatcagtgatattggacttttattcatatacttgttggctacatgtatgtgtttttttttgaaaagtgcctgttcatgtcctttgctcaccttttagtgggttgtttcatttcttttcgtgtaaatttaagttctttatagatacagggtattagagctttgtcagatgcatagtttgcaaatattttctcccatctgtaggttgtctgtttactctgttggtagtttcttttgctgtgcagaagcccgtaagtttaattacataccatttgtcagtttttagtttggttgtgattgcttttggcatcttcatcatgaaatctttgcccatgcctctgttcagaatggtattgcctaggttgtcttccagagctttcttttttttctgtttttttttttttttttttttttgagatggagtctcactctgttgcccaggctggagtgcagcggcacgatctcgactcactgcaagctctgcctcccagttcacgtcattctcctgcctcagcctcccaggtagctgggactacaggtgcctgccaccatgcctggctaatttttttgtatttttagtagagacggggtttcaccgtgttagccaggatggtctccatctcctgacctcatgaacctcccacctcggcctcccaaagttgctgggattacaggcgttgagccaccgtgcctggccttccagagtttttatagttttgggttttacaatgatgagtgatcttttaatgtgttcttgaattcagtttgctggtattttgttgaggatttttgcatttatatccatcagtgatattggtctgtagttttctttttttaatgtgtttttgttttttgtgtcagggtaatacaggtctcatagaatgagtttggaagcattctcttctctatttttcagaataatttgagtagatttggtattaggtttttaaaagtttggtagaattcatcaatagccttcaggtcctgggcttttcttggctgggagactttttattatggctttgctttcattattcattattgatctgttcaggttttggatttctttatggttcaatcttggtaggttgtatgtatctaggaattaatctatttcttccagattttccaatttattggcatattattgttgcttatagtaaccactactgattctttaaatttctgtggtattgattgtaatgtctcctttttcatctctaattttattcatttgggtcttcccctttttttttttctgagtctggctagaattttgtcaattttgtttgtcttttcacagagccagctttttctttcattgatcttttgtgttgttcttttcatttcggtttcatttatttctgctctaatctttattatttcttttctacaagtaatttggggcttggtttgctcttgcttttctagttctttaggatgaatccttaggttattgatttgaaatttttcttcttttttgatataggtgcttacagctttaaaattctctcttactactgctctcactgtatcccataggttttggcatgttgtgtttccattaccatttgttacaagaatattttcaattttcttcttaatctcttcattgactcacttgttattcaggagcatattttaaaattccatgtgtttgtagagtttacaaaatttctcgttattgatttctagttttttatccctttgtggctagataatatgcttgatattattttttaaattaattaattaattgattgattttgagacagagtttcactctgtcacccaggctggagtgcagtggtgagatcttagctcactgcaagctccacctcctgggttcacaccattctcccacctcagcctcctgagtagctgggactacaggtacccgccaccatgcccggctaatttttttttttttttttgtatttttagtagagacgggatttcaccatgttagccaggatggtcttgatctcctgaccttgtgatctgcctgcctggcctcccaaagtgctgcgattacaggtgtgagccaccatgccaggatttttttggaatgttttaagacctaacacatggtctatctttgagaatgattcatgggatgaggaaaaaacgtatattctgcaacaattaaatgaaatgttctgtaaatatattttaggtccatttggtttatagtgcagattaagtccaatgtttctttcttgtttctgtctggagtgtatttctactgttgaaaatgggatgttgaagtctccagctattattagattggaatctatctccatctatagctctaataatatttattttatatatccaggtgctccagtattgggtgaatatatatttacaattgttctatcatcttgctaaattgacccctttatcattatataatgatcttctttgtctcttcttatagctttggatttaaaatctattttgtctgatataagtatagcaactcctgctcttttttctttagtttcctttggtgtggaatatgtttttccttccctttattttcagcctatgtgtgtccttataggtgaagtgtgttttctgtaggcaacaggtcactggatctttcttcttcttctttttttttttcagccactctatatctttatgttggagagttaggtttgatttacattcaatgttattattgatgaataaggacttattcctgccattttgttatttgttttcaggttgttttgtggtcttctctttcttctttctttcattcttgtcttcttctagcgacaatgattttttctggttatatgatgtagtgtcttgttttttagtttttgtgtgtctattgtatgttttttggtttgagattaccatgaggtttgcaaatactgtcttttaacccattattttaatcagatagcaacttaaaactacttgaataaacaaacaaaaatgcaaatagaacactaataaaaattctgtactttaactttgtcccccgatccataacttattgtttctatttatatattattttactgcttatgtcttgaagagttgttgtagttatttttgattggtttatctttcaatctttctacttgagtattttacataccacaagaagagtgttataatagtgtgtgattataagagtgtgattttctgtgtacttactattgccagtgagttttttaccttcagatgatttcatattgctccttagcatccttttctttctaaacaaagggctcttttttatcatttcctgtaggacaggtctagtgttgatgaaatacctcagcttttgtttgtctgggaaagtctttgtttctcctttacgtttaaagtaggtttttgccagatatggtattctagggtgacttttttttaacttcagcactttaaatatgtcatgccactctctcctgtcctctaaggtttccactgaaaagtccactgccagatatattggagcttcactgtatgttagttctttcttttctcttgattcttttatgatcctttcttcatccttgacctttgggagtttattaaatgtcttgaggtagtcttctttgggttaaatctgcttggtgttctataatcttcttgtacttgaatactgagatagttctctaggtttgggaagttccctcttattattcctttgaataaactttctctctctctctctcaatctctcactctccctcctgccctccctccctctctgcttccctccctccctcctctttaaggttaagtactcttatattttcccttttgaggctattttctgggtcttgtaggcatgcttcattttttaattcttttttcttttgtttcctctgactgtgtattttccaatagcctgtcttcagtctcactaattctctcttctggttgatgaattcttccagtaagtgactctgatgtattcttcagtacattcattgcatttttcatctccagaatttctgtttgatcctttataattatttcaatccctttgttcaatttctttgatagaattttgaattccttctctgtgttatcttgaatttctttgagtttcctcaaaacagctattttaaattctccacctggaagacaacacatctcagtttctccaggattgtttcctggtgccttatttagtttgtttagtgaggccatgttttcctgaagggtcttgatgattgtggatgttaagtagtgtctggacactgtaggattaggtatttattgtagtgtttgccatctgggcttgtatgtgcctgttatccttgggaaggatctacaatcagagatggtggagccagccagtcttgtgttgttctcatcaggatggtgatttccctcaggccctgggcaggtccagagatgccatttgtacccaaagactggagtcaaaaccttagaaatctaccttgcactctattctatggtgggtgaactgacactcaaaccacatgacacagactttctcactcttccctccacttccacaggcagaggtgcttcatcccacggccaccatcatcacaggcccacgggggcctactaggctaccgctgatattcagttaccacccaagggctctccagtcagcttgtggtaaattctgccaggcctgggactcacccttcatgacagtgggctcctctccagtccagtgcaggtcaagaagtgctgtctaatgggagccagagcctggaatcaagaaccccaagagtccacttggtgccctaccccacagtgacctagttggtacttgatttttggttcctatgaatgtgctccctttgtgtaggtagttgtcaaacttagtcttcctactgggagggatgatcggtggaacgctccattctaccatcttgctccacttctccaatccatctaattttgatgtgtggcacttggtagttgattgatgccacatacatgaactatactgtagtctagacttttgctttaataaaagtataaatttgccttaatctccttgtttttgttgtctctttattgttctgaatttaggtgcaggaaagtagtccaaaaaccctggtctgtgaaactttccataaaaatttcagttaaaagtgtcatcctcctctgaaattctatagtattgaaaaggtaacactctcaaagagggctttttattttatattcgtctgtgagccatttctctgtggtaagactataagaagcaggaataaagaatagattaccttatacttctattatcctttttagatcctggttagattgtaggcactttaaaatttgagtgtgtttacctattttctcagttcacattttccttgtcccaaagatattttatgcacctttatctttccatctgcatgtttaaatattaaatattaaataatttgcaaaagtaattataattgctctatataagaataagaatctttaaaaaagtaattacatgtacattgttgtctcattaacattttactaaaataatttttaatttacctgaaattttctgacattgtaatattttttcatgttataaaatagcctaatgtacaagaaaatattaccaagtgacataacatgaaaagccctttgtaagctcctggtgcaatttttaataccattttggtattaagattagaagacttcaaaaataatttattctgaagatattttggccattaaaatattttctaaaatattataaaaacagaactttctgattttgtctctttctctgttgtactttatgttcctccttacatgctagtaagtctttaagtggtctctatttttcttctcttttttagatgtcatattcatactagttaatcatccacagtcagctacggggagatcgctgctttaaggctatattcatcagcttggtggttatgatgttttggtgatttatggatgtttatgactcacgtatggatacaaatgagggctgtcactgtcccatcgccttccttcccaggtcactatagtgccataccatccgtgaactaagccaaatagacaaaaatctataattgcaaaactagtcacacctccagtagaaaagaacctcaagacagatagctccacgcagtcttaggtaaaccagcacactgcagtggcatagatgactttgaactgcaccagctctaaaaacaaaattgaatatgatatttagacattctcattacacatgtgtgcatcatcaggaggcatgttttcacttctgtctctctggcttagattttcaaggcaagactttgaaaaagaactgcttgaaggagagagacagaggaactatacacatccttatatgctgaattttcacattagttagtccttaggtcagccttattggatgaggcattggtgatgatgaggcagcttgcaggcatccccctgaaaataccagtcgaaacccaggttgtgaaactgccaagtgctgacaaggatatatcaacaggctggaggagatataaaagaaatggtccttggcccatgacgtatgtactgtatctgggatatttaatgatgaagatgaaaaaacatcaacctgtgtttatctaatctattatttcagcactgatgtttatagcagattaaaaatgactggtcataattgaaagaaatgtaaaagaaacagtaatttatactacatgaaaatatttttcatggctaaatcaaatgagcattatgttttaagggattaaatatatgcttaactaccagatttctacaaatcatgctaaaattaaatcaggaatatacacaattaaaacagccaatggtaattatttaataagagtgattatcatagaacgttagtctttaaaatagtattatattgaaattagctatctgtgatagtcattagtattatactaaatattttacatttatttctaaaataatgtaatgttatagcaattttaatttacattatgtaagaaatggtcctctggtagccaggcaattgtctcaactagtataacaggtgagaaagttccctgtaaattgtgacatgcaattcaactataacctttaaaaaaataaaattagaaagtttcaaaaattttagatttcagatacactggcattaaaaaaagtcttagaagacatatccaccctctagaaacaggaaagtcggctaactcaattttccaaaacatatactctgaaatgttactatgtatataagaattttaatgattaaaagattaagaaaatgattaaaaattataccattatttcaaagttcaaactatgtataattttgtattttcacacttgactcatttcttatctttccttctaactttcctgttttctctccttgtctttggaaattataacttaaatatttctctccagacttgtatcatgtctaatgtatgacaattttatgtcatcgctgagggaatgaagaacctctttaacttaactaatgtcacatgtcctgatagtgacgtgtttgacagagatttgccatcacagttcaaggatgcaggctcctttaagaatattggctctgactgagacatttagatatgcaggaggtcatgtggtgtgcctccacctggaggcaaggggttccctggctccacatagctgctggaaacctcagccatctatgagcatgcctgcatgaattaaagattccagtggatgcaagaagattagatctctgattcacatgagttctttatgcattccaggcttctcagcagaatctggcaaaaccaccagggcaatagccctaacattgagagtgtgcccagaaatatgttttagcttgctagggctgccataacaaagcaccacaaagtgaatagcttaaacaacagaaatgtgtagtctcccagttctggaggctggaagtccaacatcaaggtgtccttagggttggctctgtctgagactgtgaggaagaatctgttcatgccactctcctaacttctggtggtttgtggcaatctttggccttccttggcttgtaggtgtatcatcccaatctctgtattcatggttgcaggacattctccatgttggtgtgtttgcatcgaaatttcccaccccccttttgagacggagtcttgctctgtcgctcaggctggagtgcagtgtcacgatctcggctcactgcaagctctacctcctgggttcatgccattctcctgcctcagcctcccaactagctgggactacagatgcctgccaccatgcccggctaattttttgtatttttagtagagatggggtttcaccatgttagccaggatggtctcgatcttctgacctcgtgatccgccctccttggcctcccaaagtgctgggattacaggcgtgagccaccgtgcctggccccaaatttcccctttttatgacaccaccagtcacactggattaaagacccatcctatccccatggtgacttcatcttgactaactacatctgcaatgacactatttccaaataaggtcacattctgaggtagtgcaggttaggacatcaacatatgaattttggagggacacaatttagttcataacaatatctaggaggccagtggtccttgaagtgccatgaatgggctggagtgcatagagcggtaggttgaggtcatacaaataaaagctacgagattgcctagggccttgtgggtggttggtaacatctcaggtttttactctgaatgatacagggttttgaacagcagagtgacatgaactgatttttaaaaagatagcactggctggcagatatagactcgtctgtaggttggcaagggtaaaagtgaagagacagcttgcaagctttcatgaatatccaggcaagagataacaccggatagataacagtgctaacagccagagctgctgccaagtggtcaggttcagaaattagaattttgaaagtagatgggataggatttaatgataaattctacgtgggatatgacagagagtggaatcaagcaaggatctaatgttttggtctgagcaattggaaagtgagaattgctattaaatgagatgggaaatgtttgggcatagtatatttaggggatgtgaacaaaagcagtctagaactcctgtcatttgcccgttaggtttcctagacttcagggtttccatttctctgtgttttgagctatttctttacttgatcatttaagacacaaatccccatcttgatagaaatcgttctcctcttcaattcatccttgtattatacttttctttcattataaaatttcatttatatttgtcaccacttaataagaaagtcatgactacttactacacttaagagtaagtgcccatttgctcttcccaggttctttattctctgcctttttattctttcttgtcatggtccagcaaacaaagggtaaaaatccagtgcagtatgatatactgacctacttaaaaacatgcaaaggacttttgtagctgtcttattaatatgcttgaaattgtcttcttcaatttatttaaaaggcctcctttacaaacagcacagacaaaagattattcagcactggataaagatagccttcttttaaagtgattacacctctttgtagaaaataatatttaggaacattcaaatagataaggtttttaatgagaatactgatgttgctatgtagacacttggagcaagaattatttactttgtttaacacgtggcttatctgccattaattaattaattagtttattgttcctccaacagaaattcattattgagttcctacatgtgtctgagattgtggagaatggagcataaaacttacttttgactcatttatttcctttgggaagttcttaaaatgccttagagatatcacttttaagacagaacacactcgtttgtagtatgatgaggttgacatgggatatttacatttttcaggctgcttcttctggcacttgaccacacgaggctactttaacatcggtgttgggcagtttctgaagccttttcctttactcccagccattgttttccgtggtttggtgttaacatctatatctgtctaagccccactcctaactgagccttcctgggctggcagcaatggcaacatccagagacctgggagcctgggagccacatcatgtgttgggggaaacaagtgagtggaaggacaggggaggataatagctggtgtgtttcaaggatggattactggaacagagagtcagagtcagtgattaatacacaatttcttaatcataattggaaagacaaaatattcctagagaataaaaaaatgagtagcagatatgacagcagaagaaatgagaaagagtacgaattatgagttagttttcagtgaccccagtgtttataccattggaccaacctcccatccacgtatttttgaaagctgcaatgcttttaactggataacaaaagactgctgagtaaatgaggatacacacatagctagcaactaaaatatgccctcataagcctatgtatgaatcattacataatatatgtcttaagactgagtctgaccagaccagaaatttctgagcaaaccaagataaaagaaattagttgctttaattctcattgatgcagcttcctgcagtgggagaaatctatgccgtttgtcttaggcttaggttccagagccttccttaaatgctctttagaatctaactttttccagctgattaactttccttccactttgtctgttggccttatcctgactcctactcatgagctcatctgcctcaatcctgacagatgtatcacttgttcttaagccctctgtgagatgcatgtcatcttgaccacatcctgtctgactctgtcttctgcccaagactgatgaacccaatccactttatctacttgggacaaacgttgttgcaatgaacagaccttcctacctctattctaagctgacttgtattggctaagcttggggtcacaattttcattactgttcagtgcacaccatcatttccttccagggtcatagttagaactttgactaacataagaatgttatctttgctaatagtaggatcaataacatgcatccactgattattgctgttgtcacactgtattccattactgtggtctatattcttattatatgatattaaaccaaccacaaactttacacaatccaattcttcctacctaaagtggcagacagggaagaaatacaatacaatcagaatgtctttctttgtatagtttgagtatcccatattggaagtgcttgggaccacagtgtttctgactgcaaatttttttgggatattggagtatttgcatatacataatgagatatattggggataggactaatatgtctaaagtctaaagacaaaatacatttatgtttcatatatatatcttatgtacaaggctttaaggtaatataatattttaaataattttgttcatgaaataaagttttgactacttttagactcaacctgtcacatgaggtccactgtggaattttccacttgtggcatcatgtcactgctcaaaaagtttcagattctggagcatttcaaatgttggatttttggatcagcaatgctcaaccggtatttgtgtttgccttcgattttttgaatggaaattgaaactcacgtctcagagaatgttgaggtattctgtagatgcagatgactatacaggtgtttgtagctggaagtaaaagttaaaatttcagagaaacaaaaaagacataaaatttttaaaatttataagaaaataacaaattaatacaattataaggatccaagtattgcccaaaaacactggagtgtgctttgaagaaaaggaggtatccttgtcttgtgatgctggtgagataaaacgcaataggagctgagtgtcttcacagagctctaaagaaaggcagggaactgctgggctgagaagaattttggaatttgtggcaagaaaggacacattagtctttctatctctcctgtctttcaaatactgtccgtaatggtagctgtcatgcattctttcattgctcttcaagggatttatcaggacacattatttcatcgtgtattattaaatcagtttttaaaatatcctgatattttaaaatcaaacacgcaataaaacctttgctagactaagtgacagtataagtttgaaagtagccagctgcctaaaatattgcacatttttcaaaacctaatttaagtatacttttttttatggtgggaaaaaagtgaatctttcattgaattttgaagacaaatcaggattcttaggtagaaatgggcatctggctatcactaactcgagtgtgcattttgctgcacttcagtaaaattttgatggcttcaccatatttttgagtggttttgcagatagcttgggtagaacaagggatggaactatatttatatttttatagacgctatctttgttaagcagatattttcttttgaaagcttataaaaatgacacttattccagggagaaatgttctcaaactgaacatcatgcctctgaagacagaatgatgtagtgaggtcttagtggctgaaaaaaatatcaagaaagatttgatagaacttatcaaaggatttaaggaatttaaaaaggttccaaaatggtgtgaaacttatatcacagatattgatatttaaatacgactgtgttgtcaatagacagaggttatgtcaaaagattgaattgtggtcagcagaatttagcctaatcttctcagtactagagattttttccacatgaacaggtacagggggcttacatttagctagatcattgttgagtgttgacattttcctagtggagtatgtctgaattgtcccttattctctcattttgtatttcatagggactcaactcttccgcattctttttcccatttattttcttttttattcccattcctgggctgttaaggacatacattgtcttttcttattttacagagaacaaaagtgtgacttaatagatttcccaaagtgacaagtaaattattaagaagttaggagctgggttaataggtccccagttgaaaaaggacatgattctaatgatgcattgccacaagactgcttaacagtatccatcttaaccgcctagtagagctcctgtgaccgagccatggaaatctccatgggtttcctgatgcaaaggaagaagtgtgggcttccctgttgagatcaggttgtcctcaggttgaagtctagtggttccagccttcttctaatgccttcctttcagaagatggtttctgggggtagggttagtatggaaattatgactacaacattaaagtggccaaactgacttttgggaattatctagtcaaacagagctgaaccttttaagaaactgtgaggtgaagtgtgcctgagtgttctgtctcctggtagggttcattgtaagctctgctttctgtattctaaatgaaatgccagtatccttttctcctaactacgatttgggtctctgcagggtgtacaaaaccaatagtgacagtagaggaatcccttggaggaaataagtttcttattattttaatcaagcacatcaattcaagtctttatattcccaggttttacagccatacatgatgtcattttcatataaaaaaatctttggagcactttttatttaaggttttatatctatttcgataaaaaatctatttcagccactgcaggctctgcttttggcacaaaagttttgctgtgctgttcaattcaaatcaagccatattcttccacctgctgtctgctgctgcagtgcccaagaagccgctactgttgtttgccttcttgctgatataagtgcttgtcccataggaaaggcatcagaggggagcccacatatttagcaaccagtggggattcttacagaaagataaagaatataaatgtaagtcacctgtttgaactagtgaaggcaaaactgctatatcctaagcttacagggcctaggaaggagataagggaaataactagaatatggatagttaaataatttgtattaaatttagcctctttgcccaaggaaggcaatgggtatctcacaggggaaatttttcttttcttttcagtttaaagcaggtggaaaagaagtctaccatgtttattgttctagaaaactaggttttgttcccaacataataacataaaatctatggggttcattttgttcagtagataaagttaaattttagattaaattttctgctgaaaagttttatataaagagagataaagctgctcagcaggcctagttcaaaaacacttaagacagctccttatgtcctatcgtggaaggagaaagaaatcagaggccccctctgggcatgggtgggctctgactcggggctgctttgtctccacatcacacctatccggggtcttcacgatttctgcagtcagcaaaagttgagtgaatgcttgggaaatgtttgcaggaggtgtcaggaaacaaaacaccctgtcattagagagcttttagtcaagtgttgagtttacactccacacctttgttccagtgacatttacgtgcattgggtcatcatcaatctggagaaactgtgcatctcaggatatcactcacagtgagtcaaagaaaaataccaagaattagcaatggaagtagccaactgatttttagggttcttttaaaatcattctatctgctttttttttttgctgttgttcataaaaatcaataactcttagttgtgtctcctgaaagaaagagattgggacataccaaatccctgaatcttgactagcagctgactacctgcctagactcatgagatattaacttagtacagcagatggtcaagcaaatgtccatcttattactagttccatagtaatattgatatgtattttaaatcaatatgtattctcttacaatagtgaatttggtgaactgtctataagccttgatcatacttcttgcttaatccaagaaagattgaattttctgctctgagactctaaactgtaagacccatatcctgatctttgatctctaaggtttattactctcattttcagaagtgacataaattttttttatcacaatctattcccatttaaacttcacgtatgtatgtccttcagtaaacatggtgctgtgttctatggcctttttatgattcatttttaacctcaactcacataataaaggctgacagtgtaatgcgtggtttgagacattggcttctggtacaagatggtgtaggttcaaatccctgctcccctgcttgctagttgtgtgacctcaggcaagtgacttaacttctgttgtctcaattttctcatctgtcaaatggagataacaatggctcagatgattatatgagctaatagacataaaacacttggaatagggcctggcatgtgataagcccaatttgagtgcatattatctaagatcccatcttcccaaggcataaaatacatgtgggtgggttgagttctaccaaaggctaaaatacctagccaatatttatattgtttcaattgagaatgccttttcttttaaagggtgaaaaaataaatggttttaaggacatgaaggaagttatactttaagtttttatctaaatctgtgataaaataggccatataaaatgtgtgaaattttgagaaactcttttcaacttacaaaggaaaaggaaatagcaagaataacaattatgtttcgtaactgtttttagctatcagtggcaagatgacattataaagtattaagaagaacaaatagacgtgaggtgatttagctccttaacgtccttttgtttaccttattgccttccctcttacacacacagacacacacatacacccacacccgaagacctgaaatcggcttctactgctgtaggagctacagagagcatggcagtgatgcagagagaagcaaagaccttcttgctttcaaaggtcaaggtcctggcttaaacactatgcttggaaaaaataccattgaggggtaaagaagaaagttggaaaacataccaaaatgatcactgccaatgagaatctgtaaagggagccgggcacctggggatctgaatctggacactatagaggctccagatgtgttagaaagtctgtgagcaggtgaggactgtctctgcttgcagtctggtatcctgggtggggctctgcttctgttgtatgttagcagccaactcaagatggccaaaggggatatcaagaagagaatggtctggagacatctttactaggattcctgcagctgagcagctgagcctctccatacccttgagaaagtcatggaagtaagttgagaaagagagtgagagggtaagagagcaacagaatgtgtgagagacagagaacaagtagactagaggggatctggacactggaatggatagggacagtggtccgtgaggaatggacaataggatcagattctctgagtgggagcacgcaccaggggatgccagttagggtagaggctgaacaagggtaaatgcctctcctgaagctgggaagctaatatataagagaaaaggcaaagagccctcacagagaagaggtaaggggatgaactatgtatatatttatgtagaattgactgaattttccctcagttaagataaagcttttttgcaactgcctgtaatggcagcttgagatagacattatatttaagtataaaacagtcaatttacagattcaaatatccaatatttgtgtgttggcaaaagaccccgcccccatccaacacacacagtattgcagactaccaaccagggatgtggtcactcatgcagtgggttctcatcctgtatggagaggagctgttccatagagaagggtttgagagcaggctgcatggaaagcctgggtgaaactgtgactgaggaaaccccacccaagtgttctcaccttcttcaggaggcatggaaaggctcctagctcaagagttgtagcctgctttggtgacacagagcatagccagtccttatatttcctgccaatgcttctagggcacagcactattgacattttggagtggataattttttgttattggagactattctgcatattctagaaagttaagtagcattgtggcctctactaactaaatgccggcagtgtcctcatttacagttgtgacaagggaaactgcctccagacgttgataaatgcgccctgaggggcaaaattcacctctgattgaaccactgttctagaatataaattctttactatataaatgtctccttgactataatatagaaaacgaaagcatcagcattctgtagatatgacaggcagcccgacgaaggtaagatacaagagatgtgataaaggctgtgaggaaaatggaaaaatgccaggcaagtgaattttggaggattggcttttagcatttttacttacatttttattttttgaatcagacctaagtaagtgtcattgaaattcaagaccttgctctggaaaactattgaatatattctgagagcagctttctcttttacctaaaatattgcctttcatctttctttatacatcctatttcccaagcacttaatcacatttattgctcacctttggactgtctccaaagtttgcatgtctgggtaaagtctggggatgctgataaagaaaacaaaaggtgaaagaagagtgaggagatcagaggaatttctgaactggagtaagatatcagaaaattttaataagtgctatagtgaagtaagggattttcaaggaagaaggataaaaaattgattgaggagactccttgcatttcatcttgaattttaataagatctagtagtgcaacattgtgacttaaaagttttgagatggagtaaagaaataatctacaaaatattataaaattaatatgagtaagtagacaataagccaggaaacaattactctgctgtcacacttatttattatactgattttactcttaagcagagttttatttaggtttcagagtaaaagaatcatataaatctttcattctcagggaaactgagattcatgatagatgtacttcctctatgccctgaaacttgattccacagttccaaggcttatgtgcagtttactctggcactattttatgttgtcacactcacaaagcctccatagttttaataatttggatgatttataggtttgggtatgaaaagctcagtgtcatcatcatgttctccaagtccctaacttatctttttcctctttaggatttgtgcctataattaattcagcaactttaacggcaaaatgtttgccttataatgagatccccagtgacacgaaaagcccatttttcaggtaagacgaaaattggtatttcttccttcgccagagagctaatctaagaacaggattcaatccatggttatatcagggtaactgatcaagtcccaacagtgcatgctaaaatgaggctggacttacactgccgctcttttcagctgaaaaacatgaaagtgattttggcctttttattatccaccatgtgctgttgcctgccttctcctagagtggttttctaggctggggatttcacttgtttcacatttcatatatcatgacttatctaagtatccagtgcctaaaacttctgctacactggtcaaacaaagagctctggggcaggaatacccttcacttacttaatgtttcattatcctggagatgcagcactgagggttttaattttctttcattttctttattttatttttagcatgaattagctgagatcacttgcctaccagatgtgtttccaacaatttattataagacatttctattattttttcttgaaattattattgatgtttgctgtgaaggtattttttaaagccgatgctgtgaaagcatctggttaagttagctaggctggttcaagaggtgattctaaggctcattaactcagcactcccatcatccaataatgggcaccctagagtaactgtggaagaaatgaacacagtgcttcctgcctggtgcctttatggagaaatgttttaaaatcaatttatgaaagactgcttaaaaagtgttattgtttacctgctatttgcatattccagggtttttataaatgttttgggtaccgagaaaataaagttgttatgtatcctataaaccttacccaccaaaaacattttaaggaaaagcttaactgtaaaacagaatgactcatttcactgaggaataggctgacattttagtgacttgtcataaatagtgcagtgggactaagtaaactgagtttaatgatgagttttacaaggtagtttgttccttcttcttcttgggctcaatgaccttttcccgagagagaggtatttatgggaaatctacatctctcttttatattcttccaaactgttagttcactaactaggagcagaggagacaagggagaataaaataaaaaaaaatacagagagaatgagagtgagcaaaggagaggagacagacagaaagagagagagagagagacagagagagagaatgcttttaccaagtgaaagaaagaaacagtacctttgcctccttggaaggaaaaaaattagatttagaatttggaggctgaggggattattagcagtaaaccagtgtaatgggggaactttgagtctccttccacaccccattactcttcagtaattatactaccagccacacggtggcttggctcaaaacccaaacagctttcttggttactcactttccttcactccctttacctcctgtcctcccactccacttcccacctctactgctacttattttgcatccatcaactttcaagctatatcctgtctatcttaatggaatactcttgtcctaaccaccatcatgttttccttggactgccaaaaatggcatcttgatttgttttactgctcttattcttgtggcttgcagcacatcttccaaagtgcagcgaaagggatctctgtcaagctaattcttgccatgttattcccctgcattaaacaatcaaaagacttttctatgcatttagaataaaggccttaggtgacttttaaacatcaaacattatcatattatattatattatggatatacacaatatgtatgtgatagatagcaggtctcagggaacactattagtgaaatattcaattttatagatttatttcccagacactgtctagaaatgagagttgattaaaatatcttgttatgctaatgagcagaaatcttaagatgtttcttatagtacatgatgaatcttttttaagtttctctgattagccaggcatggtggttcacgcctttaatcccagcactttgggaggctgaggcaggcggatcacctgaggtcaggagtttgagaccagcctggccagcatggtgaaacgctggatgtgcacctgtaatcccagctactcaggatgctgaggcaggagaatcgcatgaatctgggaggcagaagttgcagtgagcctagactgagccagactccatctcaaagaaaaaaaaaaaagtttctctgattgtatcttacagggtgtttattcattcagtcatttaaacaattatttgaattcgtagagacctggctgtgtgccaggcattgagctaaaagttgagataaaagaaataatattagactggaaggatccatgtgtccaacgtgggcacatttatgaatagcaagtttttagatgtatatttatactaaactgattcttgtcacaacagagcaacaataataataaaataatagtaatcataaccgttttggttaacatttatttatagcctttttgtcactggcattatattaagatctttatatacattatcaactgcacactcatagttgcccatgaggttggtactattattattatgtccattttacaaatgagaaaatggttttagaagtgacttggcaattgtctattcatgtccttagcccattttttgatgggattgttttttttttttttcttttcttttctttttttttttttttttttgatatggagttttgctcttgtttcccaggctggagtgcaatggcgtgatcttggctcactgcaaccactgcctcctgggttcaagcaattctcctgcctccctcctgagtagctgggattacaggcatgtgccaccacgcccagctaattttgtatttttagtagagacggggtttctccatgttgatcaggctggtcttgaactcctgacctcaggtgattcacccaccttggcctcccaaagtgctgggattacaggtgtgagccaccgcacccaggcttgtttttttcttactgacttgtttaagttcattgtagagtctggatattagtcctttgtcagatatatagattataaagattttctcccactcagtgggttgtctgtttactctgctgactgttccttttgctatgcaaaagctctttagtttaattaggtcccagctatttacctttgtttttattgcatttgcttttgggttcttggtcgtggaatccttgcctaagccaatgtctagaagggtttttccaatgttatcttctagaatttttatagtttcaggtcttaggtttaagttcttaatccatcttgagttgatttttgtatagggtaagagatgaggatccagttttattctcctacatgtggctagccaattatcccagcatcatttgttgaaaagggtgccctttccccactttatgtttttgtttgctttgttgaagatcagttggctgtaggcatttggttttatttctgggttctctattctgttccactggtctatgtgcctatttttataccagtaccatgctgttttggggagaacggtcttatagtatagtttgaaatcaggtagtgtgatggctccagatttgctctttttgcttagtcttgctttggctatgcgggctctttttttggttctatatgaattttagaattgtttttttctaattctatgaagaatgatggtggtattttgatggggattgcattgaatttgtagatagcttttggcagtatggttattttcccaatattgattctatccatccgtgagcacgggatgtgtttccatttgttgtgtcatctatgatttcttttagcagtgttttgtagttttccttgtagaggtctttcacttccttggttaggtgtattcctaagtttttttttttttttgcagctattgtaaaaggggttgagttcttgatttgattctctgcttagtcattgttggtgtatagaaaagctacagatttgtatacattaatcttgtatcagaaactttgctgaattcttttatcagttctggagctttctggaggagtctttagggttttcaaggtaaacgatcacatcgtcagcaaacagtgaaagtttgacttcctctttactgatttggatgcactttatctctttctcttgtctgattgctctggcgagggacttccaatactatgttgaagaggagtggtgagagtgggcatccttgccttgttccagttggcagagggaatgatttcaacttttccccatttagtattatgttggctgtgggtctgtcatagatagcttttaatacattaaggtatgtcccttgtatgctgattttgctgagagttttaatcataaagggatgctggattctcgaaagaagataacaaatggccaacaaacgtatgaaaaaatgccaacatcactaatgatcagagaaatgcaaatcaaaaccacaatgtgataccaccttacccctggaagaaaggccataataaaaaagccaaaaaacagtagatgttggcatggctgtggtgaacatggaacacttctacattgctggtgggaatgtaaactggtacaaccactatggaaaacaatgtggagattcctcaaaaaactaaaagtagaactaccatttgatccagcaatcctacaactggttatctacccagaagaaaagaagtcattattcaaaaaagatacttgcacatgcatgtttatagcagcacaattcacaattgcaaagtcatggaaccaacccaaatgcccaatcaatgagtggataaagaaactgtgatatatatatatatatatatatatatatatatatatatatatatacacacacacacacacatacatatatgatagaatactatgcagccataaaaaggaatgaataacagcatttgtagggacctggatgtgattggagactattattctaagtcaagtaactcaggaatggaaaaccaaacatcctatgttcttactgatatgtggaagctaaacaatgaggatgccaagccaaaagaatgatacaatggactttggggacttggggggaagggtgagagaggggcaagggatagataaacgtataaaataaaagtctgcaaaattagaaaaaaagtgaagtagttttaggaagacagccaatttattatacatattttccctttaatatatgtacacaatactgatatagtagtaaatatctatatctatgttgaaataaatcaagagttttaccaagaaagataaaataaaaaatctaagtgataaaaaaaagaagtgacttggcaatgtgacacagctagaagtgtctgagtgatttctatcccagtttcttcatactctaaagactgaccctaagccattatatataataacaagtgagaattagaaaggtaggacaagaaattacaatcgtttgcatctacctctctgttatgattgtcattcaaaataaaataggccatttcttttaataaaaagacaaaccaaaactgttatctcaaggaaattttccttgagaaagatagaccttcttgtaaaaccacatggaaaagtttacagtgctcatcataaccaggaaacatgacagatcctgagaacaagatatcatttagtttgctggtaaggcagcaatgaaacggctatggtttgaatatgcgtcccctcaaaattcatgttgaagcttgattcccaaacagtatcaagagatgaagcctttagaaagtgattaggccatgagcgctcatggatggggttaggaccttgtgaaagggctagaggggacacgtttgcccctcccatctctttcgcctgtccactcttccaccatgggaagacacagcatttgttccgagcaacaagtcaccaacgtggaagcagacagggcccttactagatatggaatctgccagtggcttgatctcagacttcctaacctccagaactgtgagaaatacaatgagaaatactgtacagaaatacatttctgctgttataaattcctcagtctgtggtattttgttacagcagcagaagtggactgagacagaaacctattggctttccataagctatattgttataaggatttctctttagtaagcagtaaagcaagtaccaaaataggaaactctgctttaagacttccacaaagagaatttttattggatgaagctgcaatatcttacaccagggttcctgaacctcaacattattgacagtttgggttggataatgctgtgctgtcaggagctattctgtgcattgttctgagaacaacatatcatttagtttggatatttatcagcatccctggcttctaccaactaagccctttctccttacccccaacaaggtgggacaacaacaaatgcccccagacattgagtatacaatttgtattcttgttgcagaggtcacacatccattgcaaacacattccctgtggcttctgtttctgaaacttatattgaatgccctgaaacaaagtgttcaaaaagcaaatgagttacacaaatgagaagatggtgcattacctaagatattcttcttttgatgaaacagaagacacacatcataaataagtgcaatggcactcaggaagaagatgaattggctattttgtcataaatttaccactaaatcatagaattgaagcaggagtttcttggacttacacagatttatccatgagggctacagtacaggtgctatcttaaattgcataacatgtcaatagacaaaaacctaattaatctgacatcattgtattcaaaagaatatggaagtcacagcaattattgtttaccagaggacaagatgcccccaaattgtactcttacaaaatactaagaaatctcaattgcaaatctgttttcccttggttttaacaggtttatgtatcaactttgtaagcttcagcattatttattagaattttatattagtccattttgggtttttaatgtgatagccacttcagatcccactgagctgtagtttatgatgtatatttcaaatgttttattcactaatttgcctcctgagaaggcatttcattttcagctggctttggagatgagaggtaggggcagagaagctaactgttcccagctgtccatggctccacaaaatcctttagcatccaacaactagaaagtcttttcactatatatatatatacacacatatatatatatatatatacacatatatatatacacacatatatatatacacacacatatatatatacacatatatatatatacacatatatatatataaaagaagcaatattggtcattcataattccttaactctcacaagaattcatgtgaaaacacatatattagttcttttattttagatggtataggcactgcttttaatagcatatatatctcatcctggtttattatcattgtaatctcaaaagacccgtctctggtaattaactttgttaatgaagacttgttcaatgaaataattaataaataatctatgtttgttcctgaggacccaatctatgcatttcaaactagtctttcaaatcttaaaattaaacttgtatagtagatcacttggattctcgtttacccttttcaatataattttaaattcaactataggtaaaaggtgaacgtcctcaaattccaaaattcttaccagatattgtgtctgggagctaatttattatttacagtatctcaactgatagatttgatctatcttattttgtatgaccaatcttcatggccatgaaaataacagtggaggccatacagcaggtcctcaaacaacatcatttcttatgacatcgataagaaaaaatattgaattttacctggggccactgtcttgtggagtctacacagtcgctccatgtcagtgtggattttctttgggtatttccgtttcctcccacatcccaaagctgtgcacgttaaatgaactggagtgtctgatgtgcctgagtgatgtgggtgtgtctgactgagccctgcaatggaatggtgtcctgtccagagttggtgtctacactgtgccctgagaagccaggataggatctggccacccagaaccctgaactggaataagaagataaataattatcttagttgtttggattaatcattcttaagtgtatatatagcctacacttagttaatattcaatattagaagtgttttgtctttatttagaagtgtcaacagctccagctggcttacagagactgcgcacaaaatgtctaaatgacttggtgctcaacagttcactttttgatataaagaaccaaattccacgtcattttaatgtcaaaaccctgtcccaaagtgaatgggatgctctacatatatgttaactcattgtgcaagcactagactttgtccatgaatattcatataacattgcccaagcctgaggaatgtacatgtaagagagaccctggaaggcttaactgctgctacctccttcccttctacggagtatatgccaccttcccaggaggctacagttcccaatctgcagattgttactctgaaaagaaagttcttccctttcttattcctctgtagatttcatggtcattttgttagcagaagtttggtgatgttttgtgaccagaattatgctgggaacataatttttgtttataacaattagcctgtggtaaaattagttatgttatatgttgtttcacttaaagtcacagtttccaaggagctatccacgataagtgaagacttactgtagttattagactggttattgactgtttcagtctttaaaagtagctaaaatcatcccataagtcctctgaaaaatcctattcagcctatgatatttttgaaaaatgtggtagatcttagatttccaattcaattttagttgtcactgaaatttaagtatccatagttttaagtgcccataattaactttttatattttttcatctattattcctaggatttttaggaacttcacttactgatatttgaaatagtaaagtcatgatgctgttattccctgcagctaccttatttttagtagtttctcttgacatcttttaaataggacttcatcttcaaaattgaatgcatcattgtgctctcttcaaagtaacttttttctcatacattttgtctacaatgacactagtttgaaacctctgaaaacttagatcttttaattatctttgaggcttgtcttccttcattacccatactcaatgtcactgatcctgacaatatctacattcgactacttctcagataattaaaataacaacaaatactattcctcctgcaggtctggttttaatacaggcactctttctactgtgacagccaatcaattaatctccccacttacattctttccccaattaggctgatgttacatactgttaccagttctatttcttgaaatatctgccttcatgttacctttatgcttctgaaacctctagtcattccctactgcatacaagataaaatctaaaccctgacgtctaacattcaaagcctatcataatctgtcatttgctaccatttcacacatagtcctcaaaatattgaagggaactaacaattccattcccagtaggtgaacatttttactgtccataaaatacattgcaccatctacttttcatacaagttgacctcccatctcacatctcaaaccttgctttattcttttgaaaaattaacaaatatcactgttcgatctcttaactattttatatcaataaatttcctacaaatatattatgtagtggggctgtggagatttcaaactaatttattatattcttcaacgggcttttagatagctggggtagcaaggaaatgtggaattaagtgctacattgtttggtttactctgtaaattttgcagtagttgaaagcataagtatctagtacttgtttaggtatggcacgtgttttcttttttaataaatggttttttttagcttctgaaagaataggcactgtcttctatttctgtgaatatgcctgtttgcatcttcttcacagggttacatggaagattgagaaaaactttattcaatgaacttgcagagttgagaaggagggtgctttttcttagcaaaactgtaggtgaattagaaatctttacccctcacaagcaaggcctgagagcatgattagcaagtgcagatgcctatgggaagcaggcaggtaaggcagatgcctatgggaagcaggcaggtaaggcagatgcctatgggaagcaggcaggtaaggcagatgcctatgggaagcagagaggtaagacagatgcctttgggaagcaggcaggtaaggcgaatgagtgagctgggctgattgcagaggtgaagaatgaatctctttggagagctgttgccttttctgaagggggcagctgctgctcagatatcactagtcctgacacttgagatttcttttttttttgtaattttttttattatactttaagtattagggtacatgtgcacaacgtgcaggttagttacatatgtatacatgtgccatgttggtgtgctgcacccatcaactcgtcatttaacattaggtatatctcctaatgctatccccccaccaccccacaacaggccccggtgagtgatgttccccttcctgtgtccatgtgttctcattgttcaattcccacctatgagtcagaacatgcggtgttgggttttttgtccttgcgatagtttgctgagaatgatggtttccagcttcatccatgtccctacaaaggacatgaactcatccttttttatggctgcatagtattccatggtgtatatgtgccacattttcttaatccagtctatcattgttggacatttggcttggttccaagtctttgctattgtgaatagtgccacaataaacatacgtgtgcatgtgtctgtatagcagcatgatttataatcctttgggtatatacccaggaatgggattgctgggtcaaatggtatttctagttcaagatccctgaagaatcgccacactgacttccacaatggttgaactagtttacagtcccaccaacagtgtaaaagtgtccctatttctccacatcctctccagcgcctgttgtttcctgactttttaatgattgccattctaacaggtgtgagatggtatctcattgtggttttgatttgcatttctctgatggccagtgatgatgagcattttctcatgtgtctgttggctgcataaatgtcttcttttgagaagtgtctgttcatatccttcacccagtttttgatggagctgtttgttttttttcttgtagatttgtttgagttcattgtagattttggatattagccctttgtcagatgagtagattgcaaaaattttctcccattctgtaggctgcctgttcactctgacggtagtttcttttgctgtgcagaagctctttcgtttaattagatcccatttgtcaattttggcttttgttgccattgcttttggtgttttagacatgaagtccttgcccatgcctatgtcctgaatggtattgcctaggttttcttctagggtttttatggttttaggtctaacatgtaagtctttaatccatcttgaattaacttttatataaaagtgtaaggaagggatccagtttcagctttctacatatggctagccagttttcccagcaccatttattaaatagggaatcctttccccattgattgtttttgtcaggtttgtcaaagatcagatggttgtagatatgcggcattatttctgagggctctgttctgttccattgatctatatctctgttttggtaccagtaccatgctgttttggttactgtagccttgtagtatagttttaagtcaggtagcgtgatgcctccagctttgttcttttggcttagaattgacttgacaatgagggctcttttttggttctatatgaactttaaagtagtttttttccaattctgtgaagaaagtcattggtagcttgatggggatggcattgaatctataaattaccttgggcagtatggccattttcacgatattgattcttctacccatgagcatggaatgttcttccatttgtttgtatcctcttttatttcatggagcagtggtttgtagttgtccttgaagagatccttcacatcccttgtaagttggattcctaggtattttattcttttgaagcaattgtgaatgggagttcactcctgatttggctctctgtttgtctgttattggtgtataagaatgcttgtaatttttgcacattgattttgtatcctgagactttgctgaagttgcctgtcagcttaaggagattttgggctgagacgatggggttttttagatatacaatcatgtcatgcacaaacaggcacaatttgactttctcatttcctaattgaataccctttatttccttctcctgcctgattgccctggccagaacttccaacactatgttgaataggagtggtgagagagggcatccctgtcttgtgccagttttcaaagcaaatgctcccagtttttgcccattcagtatgatattggctgtgggtttgtcatagatagctcttattattttgagatacatcccatcaataccaatttattgagagtttttagcatgaaaattgttgaattttgtcaaaggccttttctgcatctatggagataatcatatagtttttgttgttggttctgtctatatgctggattacgtttattgatttgtgtatgttgaaccagccttgcatcccagggatgaagcccagttgatcatagtggataagcttcttgatgtgctgctggattcggtttgccagtattttattgaggatttttgcattgatgttcatcagggatattggccggaaattctctttttttgttgtgcctctgacaggctttggtatcaggatgatgctggcctcataaaatgaattagggagaattccctctttttctattgattggaatagtttcagaaggaatggtaccagctcctccttgtacctctggtggaatttggctgtgaatccatctggtcctggactttttttggttggtaagctattaattattacctcaatttcagagcctgttattggtctattcagagattcaacttcttcctggtttagtctcgggagggtgtatgtgttgaggaatttatccatttcttctagattttctagtttatttgcgtagaggtgtttatactattctctgatggtagtttgtatttctgtgggatcggtggtgatatcccctttatcattttttattgcatctttttgattcttctctcttttcttctttattaatcttgctagtggtctatcaatttttgaaaagatcaacaaaattgataggccacgtgaaatttcaagtccagggttgcctgatctaatttctcaagagaagatggagacttaaatttttttttcttttttattatactttaagttttagggtacgtgcgtacaacgtgcaggttagttacatatgtatacatgtgccatgttggtgtgctgcacccagcaactcgtcatttaacattaggtatatctccaaatgttatccctcccccctccccccaccccacaacacttggatccaacccaaatgtccaacaatgatagactggattaagaaaatgtggcacctatacactatggaatactatgcagccataaaaaaggatgagttcatgtcctttgtggggacatggatgaagctggaaaccatcattctcagcaaactatctcaaggacagaaaaccaaacaccgcatgttctgactcataggtgggaagtgaacaatgagaacacttggacacaggaaggggaacatcacacaccagagacttacatttttatgagaaatatccaattgttttttgttctagaatttgacaggccaaattctgtatctctcttggctgaatttgtcctgcagactgctagcttgcaacctcatctctagagaggtttttgttgttattgatgttgtaattatagtacaactacaactctctcatctgacataattagcattagtagctggtcagttagtttagttcaaaacatcagttaaagatgtttatcataaggaaatgattggcctgtattatgaaattttcagaatacatgacaatgcatatcccaagtttatgttaacttagaacataaattacatatacattatgttatatatacagtaagttcttttagcaatcgtttttataatttttaaattaaaaaatatgtatttttcatgttgagacagggtcttgctatagtgcccagaccaggctcaaactcctgggctccagtcattctcctgccttagtctcccaaaatgatgggattacaggcatgagccaccatgccctgccttataatttctaaaagttttaaaatttattttatttttaaaatatatatgtatttcctagggtacttgttcaaaggtcactgttctttttatgctggagtaaatccttttctctgaggatgaggtcactggctggactgccgaattgtcttccttgtgtagaccacactcactgtccttcattcccagttttcatttccttaaagtgggggaagaatatttgccaggtgggctcagtgtagaatccttctcaatttctatgactttcttacaacttttacgttgccttgtccccaaatgagcttatgatattttgagtgactcacctttagtaaaagcatttaaccaaagtatttaaattagtattcttagaataaattctcttttcatacttctatttcatcagtttacataatagttaattaatctagataattacaatgtaaagtaaaaccagcaaaaacaaatttgggaataaataaaactgatttctggcaagcattcaactcaacagatgggagcagaagtgcacaggaatataaagattaggcttctagccacaagatccagcatgctgtgggtggcaatcagtaagtttcaagggaagactacagaacttgagttaagccagccagttgattaagtgaaggtcagttgagtaagaaacatggtatagcattatgtttcatagtatcaatctatagtatcagcctaatattataaaactttaggatagtacagtatcaattactttcaatgactcacagggagatgctccagagttgaaaaacataagcctttcatatgcttttggtaaattttcgggtagggggagggtgtcaattctaatcctgtgcacaggatatatgcttccaaagcaggctgtcttgagtaaaaataatttctatactaggagtagtaaaatactttagtgaaattttgcttcatgcaagcatacagagctgcacttggaaagagatactgtgtgaactattacaagtgcaagagaagagaatgttccaaagtttaagttgcttctctagaaaaaagaaaatctgttttctcacccagacattccattctattctgttctcagttcttccgtagagtattataaaaatggttcacacttagattagaattcagattttatttgttcatcttctttgaaggaatctaaaaatattctatgcacttcttccctccatgttcattatttttaacttattgttgattgttgttctacagatattgatctgactacattagatcttagaggcattgtttaggctcatggacattacctgcacttacttttaaaataaaggatatgtttgaatttcagaattacaaaaaatttaacgtttagctaaacacgcagttgtttttagaaatacttgtggaaaactgacctttcccgctagtttcataattgccaataacagtaagtaaagtggatattttaatacttgctcatcagtaaatgtttacaaagcatccattaagtaagttatctgtcctccaggagtgtccagcatttctcaaaatggtctacgaatatcctacaggagttcagcttgcagtttcctggactctgattctgatccatggagttgagtcatcaattagggagtatgggatctgcatgtttatcaagccctgatagtgattttttcacagagtgacactgaggaccagtactcctggcatttgcaattcatagagaaattagaaatgatcaccttccacgcataaactcaaagtggtgattaaaatttggcagaaggcaaataatcttttcctaagatttgagctcacactacagtttttgccaccctggccattctgccttgttgaactttggaaatttgtgccagtcaaactcataaatgactaataattaagtagaatagacctagaatgctgctaacagggtggtgatacatggtgtttagaaacaagggagattcaattcaggatgttaaccataatcaggagaaacaggcaggattccttgatgcaggaaaataataaggcagaatccacaggtaattatttctcagctatacctcttatggagcatggagggtcctagactcactgacattgtttatagccagtaagaaatcagaaacctgcaaataaattctatttctgtcaaactagcaacctaagatctaggattacacagcttgccttgattctcaagatctgatcaattttttcgggacccatagctcagcatccattgtcatgctgaggccatctagaaactgagctttattgagagctcattgtgaaaagtttgtgggctgtgtaaaagctatcaaagaaacagcagcataaaggaagctttttgttctgttgattgtattttgcttcaaaagcagactcgttatctttttcacagataagtgccatttcaaaattgattaaagtctattaaagcattccaggtgtctgatatttaaatataagaactattttttcagtttcttatttgatgaatgtgtaataggtagagacttgtgactcctttaaagttttatttgctctgagtgtcatgaaatgctagaagacataatattctaatttatacctatgctcactttgaaggatacatataattctctttttagtaagtcacactttgctccatttcaccttttgaaaatgtcatgtgtaaccttttaaaattaaagaccacgcaactgataggcagcctcacataatatagtagaggtgaaggttttggactgtgtgctagctactgagagagcttatatggagtcacgctctggagatcttaaagaaaagggtggatgctgttttcctgaactgctttcatggcagttctctcagaaagaagagcaaagacccgactagctgtttaagtctattcaggggtcagttggttcacacgtggactactgtcttcactgaacagctaataggaatgtccagctaggtcccattaacttcagccttgtcctgggactcctggccacatctccatcttttctgcttttctccatttagctgcacaaacaataatgtatcatacattttacatttttgagaagtagtgtctcaattttttccaagactggataagtataattttcatctttatttcatttaatccagaggtttttgaattgccaggaatttgttaaccctttactgacttctttggcctagatgaaaactaacatcgtatgagttttaggtctgtgatcaaatttatgatgtcatatgacaattgtgtttgtgtgtcaggaaaggaggccttagttatttgcttgacacatttgaaacatttatagattttgaaaatgcactatggtacttttgagtctgaaagttagacctgaaaccagaccattttactttaccctacatatttcaatttttttcctattttttagttaaaagatgtgctagttccttttaaacagacttgaaaggaaataatcttcctactgataaaattaagttgcttctagcttaatataaagtactgccagtcttgctcatgtaggcagctaatacttgcacaacttgaatatgtgggacaccatagaaaatcaggagtgttaatttctcaaggaagggatttctgaagagaagatggctactgtttttagaatctagtctcatgctttatataaccaacagatttctggtttctaaaatttcatttgtacctagaaattaatttgttactcatatatttgttgatcgtccaggattgtattacttctcaaaatattacaagggcatactctgaaccaagaaagggtagctatgttttatgtggtaagtgattattttggctgtaagttttagtttttaagtgacctctttaagaaatatttaattgacaaatgggatctaattaaactaaagagcttctgcacagcaaaagaaactaccatcagagtgaacaggcaacctacagaatggaagaaaatttttgcaatctactcatctgacaaagggctaatatccagaatctacaatgaactcaaacaaatttacaggcataaaacaaacaaacccatcaaaaagtgggcaaaggacatgaacagacacttctcaaaagaagacattaatgcagccaaaagacacatgaaaaaatgctcatcatcactggccatcagagaaatgcaaatcaaaaccacaatgagataccatctcacaccagttagaatggcgatcattaaaaagtcaggaaacaacagatactggagaggatgaggagaaataggaacacttttacactgttggtgggaccgtaaactagttcaaccattgtggaagtcagtgtggtgattcctctggaatctagaactagaaataccatttgatccagccatcccattactgggtatatacccaaaggattataaatcatgctgctataaagacacatgcacacgtatgtttattgtggcactattcacaatagcaaagacttggaaccaagccaaatgtccaacaatgatagactggattaagaaaatgtggcacatatacaccatggaatactatgcagccataaaaaaggatgagttcatgtcctttgtagggacatggatgaagctggaaaccatcattctcagcaaactatcgcaaggacaaaaaacccaacactgcatgttctcactcataggtgggaattgaacaatgagaacacttggacacaggaaggggaacatcacacatgggggtctgttgtggggtggggggagtggggagggatagcatttggagatatacctaatgttaaatgacaagttactgggtgcagcataccaacatggcacatgtatatgtatgtaactaacctgcacgttgtgcacgtgtaccctaaaacttaaggtataataaaaaaaatagaaaaaaaaggaatatttaagtaaaaatagttattttagcaataaaaaagaaataatagcaggcttattttttcttactggaaagttgtccagagaaaacaatttaaatttattttgaaagtactttgcttactatatgaaccatatactgtatgtgatatagtgtctaaagaaacattattgtgaacaaaagacaatattcaaaatatactttcacaataatgtttatttaaaagcttcacattgggggaacttcctgaacctgaacaaagaacacctacagaagccttaccagtattatcatacacaagcatgagaaattggacccttttctcctaagatcaagagtgaaaaaaagattcctcttgttatcactcctgttcaacattgcactggaagtcctagcaatgcaataagacaagacaaaaaaataaaatgtatacaaatttgaaatgaagaaattaaactttgttttcagttgaaatgaagacataaaactatctttattttcagatattacagtttatatagcaaatcccaagaatcaacaaaaaaattcctcgacctaataaattattatattaactaatgttaatatactgtaataagtaactaatttactaattaactaataagtgattattttaacaggatgcaagttaatatataaaatcaattgttttcctatgtattatcaatgaacaattgaatttgacacaaaaacagtacattgtttacaataacaccaataaatataaatacttaggtatatttctaacaaaatatgtacaggatctgtatgtggaaaactacattttaaaaaagtcttaaaaacgaagggatattctatgttaataaattggaaggctcaatattgtcaggtttacatgggaagacaaaagaccccaaattgtcaacacaatatgtaagaaaaagaacaatgttggagtaacactacctgacttggagactttttataaagccacaataatcaagacagcctgatatttgtgaaagaatggaaatgtagatcaatggaacaaaatggagagcccagaaacagattcatacaaatatagtcaatagttaactcttgatagaggaacaaaggaattcaatggacaaaggatagtcttttcaagaagtgatgttgaaacaattgtgttgctgcatgtaaaaaagtaaacatagatacagacattacatattttaccaaaatcaagttaagacaggatatagactcaggtctaaacggaaaagtataaagctctggaaaaaaacacaggagaaaatctaggtcacttgggtttggtgaagaatttttagatacaacaccaaaagtacaacccatgagagaaaaaattaatatttttactaaaattaaaaacttctgagtgacattgttaaaagaatgaaaagaaaagctatagactgggagaaaatatttgtaagacacatgtttgataaaggacttgtatccaaaatatacacacaaaaaaaacttttaaaacggagcgataaaaaacaaacgactcaattagaatgtaggcaaaatatcttaacggacacctcaacatgtaaacacagatgacaaataattatatagaaagattctcaaaatcatttgtcattagaaaatcagaacttaaaaaaaaatgaaatatcgctacacaataccaaaaattagacacaacacagaagaacaggaactctcattccttgtcaggagaaatgcaaaataacgcagccactttggaggcaatttgacagtttcttacaaagcaaacagccttatcatatgactcagtaattatgcttctaggtatttacctaattgagttaaaactcatgtcacacagaaaccggcatgcaaatgtttatagaagtgaaaggagttggccagcttactttaggcagacagtaagggaagggtccctggagaatctcccacgcaacccacaagtgtttacaccagatgttttgtgcagatgaaggaacttgcataggggcggtgggtgggggggttgcgtaaacatgcccacagtggaaaattctgttccttaacacatgctcagtaaaggaaataaatcagtacggagtggctcagactaagggcctgcatggccaccggaaggatggggggtggagccatcaggaattcgcaccttatacaaatagggaacccagccccttcagcttgtacatatagaagcccttgtattcagctgtgaagggggcaactgggagcctgttttcaggactcctctctttgctgagagctttccttttgcttaatgaattctactccactcactctttgagtgtctgtgtgcctacttcttcctggttgtgagacaagaacccacacctaactgagctaaggagtaaaaaatcctgcatcagaagttttattcataattacctaaaaccagagatacctatcgtctctcaatatcttaataggtgaattgataaagaaactgtggtacatccatgcaatgaaatattattcagcaatgatctatcaaagaaatgatctagcgaaccatgaaaaggcagggaggaaacttaaatgtatattattaagtgaaaaaaagtcaatctccaaaggctgcatgctgtatgattctagtcatagatgttttagaaaaggcaaaatgatggagacagtaaaaggatctgtggttgccaagggttagtggggagagagggatgaataggcaaagcacagaggatttttaagtcaatgaaactactctatgtgacaccataatggtaggtacatgccatattaattgcccagatccacagaatgtataacacctggagtaaacttcagtataaactatgtactccaggtggtaatgatgtgtcaatgcaggttcaacagtgtaataaatctaacactccagtggtggatgttgatagtaggggaggctatgcatgtgtagggtcagggtatacaggagaaatctctgtaccttcttctcaatatttctgtgaacataaaattgctctaaaaataaagactattaaaaaaaggctatacaccatataatttcaatcatatcacattctggaaaaggaaaaattatagagacagtaaaaataaattcagtggttgtcagggattttgagtcggggggaggcatgaatagtgaagcacaggggattttttaaggtggcagagccattctgtattatactgtactggtggatatgtgacaaatatgcatttgttgaaattgcacaaaacagagtgaatcctaagataaattaaggactttagttaacagtaatgtatcaattttagcctttcaatggtaacaattatactaccttaatgcaagaaattaataatagcagaaaccgtgggatgaaaaggcaggatagatagagggagtatatgggaactatctatactttctgcacaagttttctgcaaacctaaaattgttctaaaagtagtctattaagaaagaagtaactttacacatcacttatccagcttcagcaagtttcaccattttctatatccttttatccatccaacttcacacagtaaaaggttggagggtttttcagggtgggtgagctagtggagaagtactgttgggggaagttaggggcaaggttgaccaatgggatatgtttagcacattgttattcttgagtttgcaaatgtttttttctgtgtttgctgattggcacccatggaggttaggtacccttccacagagactagaagataagggcactctctttcttgatgattatatttcaaagagatagctcccagatctttgagaaagatggtcccgggttgtaaaactggcaagaggcttgtaaaaagatttatatcatgaaaggacaggaaaaaattaatgattataaattttctaacgtaaatgctgtaaacaaagggaggtcagtgtttagagtcaagaagaagcctgtctaaaatgtagtcaagccaagaatgttaaacttgtcttcatcactttcatcacttactcctcttgtcccagaaatgtgacttattaggaactgaagtcctacttgggaatcccactcttttattggctaaggttctagcgctaatttatggatgctctttttggctagaaaatgtttcaacttcaagacaaggaatgcagaagggtaaaaatagtagggctggattaagacctgcagagttcttaataagcactaaaaatattatgttacctctaatgtgtaattcaaaacaaaatcaaaactaatctataaaaattataagaaatcccaacaaagttctgatttttgtttctttcttttcttttcttgagacagagtctcgctctgtcacttaggctggagtgcagtggcacgatcttggctcactgcaacttccgcctctcgggttcaagagattctcgtggctcagcctcctaagtagctgggaccacaggtgcatgccaccacactcggctaattttttgtgtttttagtagagacggtgtttcaccatgttagccaggatggtcttgatctcccgacctcgtgatccgcctgcctcggcctcccaaagtgctgggattatgggagtgagccaccgtgccctgtctgtatttattaaaagataattttagtgtgtatatttaatgtatacaacatgatgcttttatatacaatgtcgaatttaaataataagattcagaaaatatgattaatcatagaggtgactcaagcacaaagcttgagtatagtcatctggtaaacagactccaaaggaagggaaacagatgccaaaggaacaaagtcagtgctctcaagtggtaaagctaaggttttacttatatggacagaaacatttttaggagggttgcaacatttttcatacaaggacagtacacacattatagcaatttgatgagcacagcttgctacattccaaggaaatttgctttaacatttcttgaggagaaataatgttctgaggaattcttatttctggcaccacttggtcattcctaattatttacagaaaaaagcagaagttgcaactgcatgctacatgtctcaagctacatagccacattcctcccagggctcagggaaatttagagttcgaacagctttaagtgaattatttaatttcacaacatatacacagtgaaatgattatcgcagttaaacaaaataacatatacctggccttcaacagtagcttttttttgggtgataatagctactttagcaagatttcagtatacaatacaatattgttaactttagtcctcatgctgtatgttagatcttttagatttactcattgtacctaacctaactgcaaatgtgtactctttggcccacttctctccatttacttcccttctctgcctttggtacattctagttgtttctgtttgactttcttttctttttttggatttcacaataattgagatcatactataattttcttttggtgtctggcttatttatttttattttttatttatttttttgagacgaagtctccttctattgcccaggatggagtgcagtggcacaatctcggctcactgcaacctccgcctcctgggttcaagcgattatcctgcctcagcctcccgagtagctgggactacaggcgtgcaccaccatgccctgctagtttttatgtatttttagtagagacgaggtttcaccatattggctggtctcaaactcctgacctcatgatccacctgcctcagccttccaaagtgctgggattacaggtgtgagccactgcgcccggccctgtgtctggcttatttcacttagcataatatcctcagggttcatctacgttgtgacaaatggcaggatttcctttttctttaaaagcctgaatagtattccattatttatatatgctacattttctttatccattcatttgttgatggacatttgggttgatttaaatcttggctattgtgaatagtgctgcaatgggagtgcagatatgtcttcagcatactgatttcatttcctttggatatatatccagagtcctgaatcatatggtagttctatttgtaatgttctgagcaactttcatactgttttccataatggctatgccaacttacattactaccaacagtgtaggattttcttttctcaacattctggccaacacttgttatctcttgttttattttatttttaaacaatagccatcctaacaggtgtgatgtgatatctcatgtggttttgattggtattaccttatttctaaaatgcaaattattacaaaaaattgatgtaggttccttagatttgctggcactgaaagctttgctgcctgcttgggcagcctgcactgaacagtgtgctgtgttgagccagtggcctagatatttaagattgacctcttattttggtaacagaggatcattcacattaaatcatgtgtttttttgtgtgtttttatctcctgctctttgaatcaaaatcattggtatcacgttacctctttttcctgacacaaaatttagaatttgcataatgggtatatttcttccctactctctggtctctttcttgggttgcactcgaggaaagcattgtcattcaaatgttcttttaatcatccagttcataacattacttgcaatcagaacaggtttgtaatttgtgaaccatgtgcaaagaggagatatcttgcttcactgagaaaatagacaattttgtgaaatattggccatttatctgccaaagtgggccattatacattgaaccacagtaagaagccaccatgcacctccatccttttcatttatgctttaatggaggtttttttctttttctatctcatataaggctgatccaaattctaccatatttaaattcactttcaacaaaaatatgtatatgaaaatatcaatcaggagactacaattagaataaaattaaaatgcctagtcaggccaaatgcatttttttcaattaaagaactataaataattaagaaaatgatgaggaagatgggaatggaaaatagcatgggttttcttttctctccactgccttgtcttcttatgcttggtggcatctaatgcagtagacataaacactatgctatgaactgcgtttaggatccattattccgtatagaacattcaaaatgctgaagatggtttgtagttggaataagtatagaactaattatcagaaggcttgcctttcaattcttgtgttttatagtctacaacatataaattatgtgatcctagatgagtcattaaatgtttctgagtcctgactgccttatctaaaaaatgagaataataaaaatattcttgttttctctgttacaaagttgtaataagcagcaaacgattttatgtatgggaaagcagactacaaactgaaaagcaccgtaaaggattattatttatgcttcagtgcatgcattgaacatggtctgtgtaatctgtattttcagaaactaaccctccatcatgttgacgtttgctaattttaaatcatgctgcaaatgaatggttcagattggaacacctgctatcattttttaagaaaatgactatcatttgatttacaagaacattttatcttaataagttcagttcagcatttattagcatgtattagtctgaaattcccttcacagaaaatcatatttgatttttttttctcagatgtcagagtagtaaccatattattctcaaatgctatactcagtaggatcatgaaactcagtgattttcattattttctcaggagtattgtaaaaattgtaagatttaaaaataagtaaaagactataatttcactcaagcaaatgcaaaccttatgacatcatatttatgtattatataatatgttctatattatgtaaatacaataacttcattttccaggcaataagcatatgttaaaccacatttcctatttcatatatttttaaaaaccatataacatgaaatattataggagagtttccaaaaacagacgtgaataccatagcacaaacacaaaataatttttattttttaaaaagttatatttggtgcattagacattgaacaaaagcttatgaaaacttcacagaactcatgctcacgatcatccagtgagcatttgtgaaacacgccactataacagatttttaaagggagggaaaataagggaatatttgaccactgctcttactatgtagtttgatggcaaggtataggcacaggagaaagtgctcagtactatgctattcttggagaaaattagtaattgaatataaaattctatatttgtttagggaaattaaacattattttctttgaggaagacacctgaataaaagtggtagttgagttgaagatgtgcatgatttgaatagaaggaaggttgcagagtggacgaactacataagcaaacttggcatcagaaatgaaaagatgtatgaagttctattctttgaaaattatattgttacttgctatctacccagattttctggttttatatctctgaaaagaaaattgtgttaaatagagaaaaattatcactgttgcccttaaattgaactaaatgtaacctactgatattttccttctttaaacctcgttgaaagaagaccatccaacaattcactttatggcattcatacttcataatgaatatcattgtttccatatcatcatttattttgacacagcttgaaatgtcctaagctgtgtgttttgaagttgtatattttctgagctggaaatctcagaaattatgaatggcttctgaagtatggtaaaaataacgctatgatttttaggttcttttgtgtctcctaaatatgtttctctgcacagtggttctagaaagctgtgctatataagaaaatttcacaaagtaaaacagttgcctcctcttttcaatattctcctttaaagagactgattttttttctcattgtttagcgttttcaatagtagcattgtttacagtatagcataatcttaaaattggttgccctttaagtggtatcaacaaataagtactctaaactttgtttcattttataaagaattttaatgggtctttcacaatatgcatctaacttctgaatcaatacacatattctctaaacagcatgagggcagggagtgtaagaatgcatgtatgttatctttgcaggggtctttgacatatattggaattttacaagtggtccaggtatagagagggaacctttagaaatcatgtttctactctaaacttttaagagcatcctaaaatacagtgctttgtgggtacaagtagttcaaggataaatagaggagtaatttgccatttgtaccaaattaaatcagactttcagttcaatcaaaacagcttgcagctggatgcaataatctgatttcctgacactcagagaaaaattgaagccctccaaaaggcccctgctgatcttcaacatgaaatacagtttgctggcaattttactcaacctctgaatgccttcacatttaataagctaaaaaaatgcaaataaagcataacgttagttggcaatggctctcaggtagtgttttattacaactaaatgaaacacacagcacaatgcctccaaaggatcatgctcttgttctttctcaaagtagctattttgctaaatatgtcatcagatgaatctctgtattagtgtcctgggagtgctgttttgacattggatgtgtgttgaaaacataataaaaggcttcagagaataaatgctagaattttgtatgtacaacttgctattttcctgggaaggtaatgagacagataaaaaataaatccttgagtatctattaactgttgattattcgagatagtgaggatccaaacctacagatatattcagttctggaaaattagatcaatttatgacattttgcatttatctctagtttttaccacacaaactgatatatgcaggtctttcagcatgttgaatggactttccagaattgaaaactgctgaattaaggacaaagaagcagaaagtgatgcattttctcaggaaagcaccttgcatttgaaagctgacactctcttgcggcctcattacgaggcgtcaaatctgaccctgcttcctttatcacaaatcttatccccttcttaataaacatacaatttaggggagcagagagagtcaaaagaaggacattgtctagattataaatcctcagcatcggatgattttccctcctttcctgtggggcaggaaaagaggtgctcagcccatttccagtcatgatcctacagtgaacagaggacacactcgtgtagtggaaccgaggagggatttgcgaagggattatttacaaaggtgtgaacagagttaaggaaagccaaaaggcacagagaagcatccagctatagcaacagtgggaagctgcaaccaccattagcaaggggaggaaatggttactagacccagtgagagttgcagctgcagaggagggcagcctggcaggacctttttctgaataagaatgcagtccccggcagtccatggcccagtatgactcaaggaaacagataccgcaacatctttctcccaactccggtctcccaccagtgcctcccagccagaagccagggagcaaaagagttccttggagcagcatatagaggtcagcattctggggacccagagcagagagaggagctgggaatggatctggaggggcaagcagagactatccagagctctaggatggcaggggcactccactagagggatctcgaagacgggccttgggatttcattccctgattggaatcttcctgagctgctgtgctggtggaaaagcagtgcaaaaggtgacccaaccctcactctcctccaaatcctttggtctaaacccagggtaatgctggggaggggaagaagataagcattaaattgaatatggtgtttgatatactattgaagtgttaaaccgtatcgaattggattggaatttttattaactaaaagtgaatgggaagctttaggacctatttaggttgccattaaggggataagatacagtgattcaacagagcatggtgttagtcaatggttgtaaaaaaggaaaatcattacctgtttgtattttactgagttaatactcttcaataaactaattacctaggaaaacttgggaataatagcatgagtgtacaatttatgtgacaaattacaatttatatgcttgtgatctaattgtggcagccctccaaagatgtaactgcatattcttgactctgaattgttagatgaaaaactaggaacaatattgcttttcttaaaatcctattgtgaaatttttattctgaagttaaggaatacttcttcttttctcaggaagtcttaggtcaaattgcccttaagtatagaaattcttattaaaatctatagcttttaaaatcctgactatcaaagaattttacattgctttaaatatttctattttgccatgcacctcatcactatatgttatttattttcaagcaataacaaactggtgaccatctagtggaagaatcaagaggctctgaattcctcttcagagacttcttagcaccctgaaaattatcttcctaatccaaggtgagctctttggagttaagtgggatcattcattgggcaccatagtcaatagttttgctcatgtgactactatcttcttccaggcactgggaaaatggaacttcgtgccctctgtggttgagtagggccatgcaactagtttgggccaataagttgtgatttagctcgtacttgtaattttcaggaccaagtatctccccttaagagtctggagttgttactgttgcatactttaccctttctgactaatatactgggcaagatgaagtgtacaggtcttgagagttcataaacatgtagctctgtttcagagacctgtgtatatagtcaactgatatacagatatctgaagccacataatatcttaagatcacctgagccctcagcctgactgggaggcatgttcatggatgaatttacagtgcaataataacactttgccactttcagagaaaagatagtcatggaattcgctattagtctacctgggctaccagaaagctagctgtaagacatataacacatctttagtaaaatagtacagtcttctatacagtttcctgcctctcaaatagatatgaaacaattgatccagcttccctgtggtagggttctattaaattccttttattcttgtactcttttcattttcttttcaatataaaagcaatggtgaagccgtctggtgtcaggattgttctcagaggtctctttaggcatctcttcctcttcccccattccccaaaatctacactgacctacaaaaaacttaaacaaattttcaagaaaaaaaaccatcaaaaagtgggcaaaggatatgaacagacacttctcaaaagaagacatttatgcggccaagaaacatatcaaaaaaagctcatcatctttggtcattagagaaatgcaaatcaaaaccacagtgaggtaccatctcacgccagttagaacagggatcattaaaaagtcaggaaacaacagatgctggagaggatgtggagaaaagaaatgcttttacaccgttggtgggagtgtaaccattgtggaagacagatcaaccattgtggaagacagtgtggtgattcctcaaggatctaaaaccagaaatagcatttgaccaagcaatcccattactgggtgtatacacaaaggattataaatcattctactacaaagacacatgcacatgtatgtttattgcagcactattcacaatagcaaatgcccatcaatgatagactggataaataaaatgtggcacaggggggaggagccaagatggctgaataggaacagctcccgtctacagctcccagcgtgagcgacgcagaagacgggtgatttctgcatttccatctgaggtaccgggttcatctcactagggagtgccagacagtgggcgcaggtcagtgggtgcgtgcaccgtgcgcgagccaaagcagggcgaggcattgcctcacttgggaagcacaaggggtcagggagttccctttccgagtcaaagaaaggggtgacagagggcacctggaaaatcgggtcactcccgcccgaatactgcgcttttctgacgggcttaaaaaacggcgcaccacgagagtatatcccgcacctggctgggagggtcctatgcccacggagtctcgctgattgctagcacagcagtctgagatcaaactgcaaggcggcagcgaggctgggggaggggcgcccgccattgcccaggtttgattaggtaaacaaagcagccggcaagctcgaactgggtggagcccaccacagctcaaggaggcctgcctgcctctgtaggctccacctctggggtcagggcacagacaaaaagacagcagtaacctctgcagacctaaatgtccctgtctgacagctttgaagagagcagtggttctcccagcacgcagctggagatctgagaacgggcagactgcctcctcaagtgggtccctgacccccagcaggagcacactgacacctcacacggcagggtattccaacagacctgcagctgagggtcctgtctgttagaaggaaaactaacaaacagaaaggacatccacaccaaaaacccatctgtacatcaccatcatcaaagaccaaaagaagataaaaccacaaagatggggaaaaaacagaacagaaaaactggaaactctaaaaagcagagcgcctctcctcctccaagggaactcagttcctcaccagcaacagaacaaaaaaactggaaactctaaaaagcagagtgcctctcctcctccaagggaacgcagttcctcaccagcaacagaacaaagctggatggagaatgactttgacgagctgagtgaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacatgaagaatgcagaagcctcaggagccgatgcgatcaactggaagaaagggtatcagcaatggaagatgaaatgaatgaaatgaagcgagaagagaagtttagagaaaaaagaataaaaagaaatgagcaaggcctccaagaaatatgggactatgtgaaaagaccaaatctacatctgattggtgtacctgaaagtgatggggagaatggaccaagttggaaaacactctgcaggatattatccaggagaacttccccaatctagcaaggcaggccaacgttcagattcaggaaatacaaagaatgccacaaagatactcctcgagaagagcaactccaagacacataattgtcagattcactaaagttgaaatgaaggaaaaaatgttaagggcagccagagagaaaggtcggattaccctcaaagggaagcccatcagactaacagcggatctctcagcagaaaccctacaagccagaagagagtgggggccaatattcaacattcttaaagaaaagaattttcaacccagaatttcatatcccgccaaactaagcttcataagtgaaggagaaataaaatcctttacagacaagcaaatgctgagagattttgtcaccagcaggcctgccctaaaagagctcctgaaggaagcgctaaacttggaaaggaacaactggtaccagccgctgcaaaatcatgccaaaatgtaaagaccatcgagactaggaagaaactgcatcaactaaagagcaaaataaccagctaacatcataatgacaggatcaaattcacacataacaatattaaccttaaatgtaaatggactaaatgctccaattaaaagacacagactggcaaattggataaagagtcaagacccatcagtgtgctgtattcaggaaacccatctcacatgcagagacacacataggctcaaaataaagggatggaggaagatctaccaagcaaatggaaacaaaaaaaggcaggggttgcaatcctagtctctgataaaacagactttaaacaaacaaagatcaaaagagacaaagaaggccattaaataatggtaaagggatcaattcaacaagaagagctaactatcctaaatatatatgcacccaatacaggagcaccaagattcataaagcaagtcctgagtgacctacaaagagacttagactcccacacattaataatgggagaccttaacaccccactgtcaacattagacagatcaacgagacagaaagtcaacaaggatacccaggaattgaactcagctctgcacgaagcagacctaatagacatctacagaactctccatcccaaatcaacagaatatacatttttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaaaccactcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatgcaaaattgacaccctagcatcacaatgaaaaaaactagaaaagcaaggcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaacaaaaaaagagagaagaatcaaatagatgcaataaaaaatgataagggggatatcaccactgatcccacagaaatacaaactaccatcagagaatactacaaacacctctacacaaataaactagaaaatctagaagaaatggataaattgctcgacacatacactctcccaagactaaaccaggaagaaattgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagcctggcagatatacaacaaaaaaagagaattttagaccaatatccttgatgaacattgatgcaaaaatcctcaataaaatactggcaaaacgaatccagcagcacatcaaaaagtttatccaccatgatcaagtgggcttcatccctgggatgcaaggctggttcaatatacgcaaatcaataaatgtaatccagcatataaacagaaccaaagacaaaatccacatgattatctcaatagatgcagaaaaagcctttggcaaaattcaacaacccttcatgctaaaaactctcaataaattaggtattgatgggacgtatttcaaaatgataagagctatttatgacaaacccacagccaatatcataccgaatgggcaaaaactggaagcattccctttgaaaactggcacaagacagggatgccctctctcaccactcctattcaacatagtgttggaagttctggccagggcaattaggcagaagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccagccacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcctaaggtaatttacagattaaatgccatccccatcaagctaccaatgcctttcttcacagaattggaaaaaactactttaaagttcatatggaaccaaaaaagagcccgcatcgccaagtcaatcctaagccaaaagaacaaagctggagagatcatactacctgacttcaaactatactacaaggctacagtaaccaaaacagcatggtactggtaccaaaacagagatatagatcaatggaacagaacagagccctcagaaataatgccgcatatctacaaccatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaactccaacaaatttacaagaaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccacaatgagataccagctcacaccagttagaatggcaatcattaaaaagtcaggaaacaacaggtgctggagaaataggaacacttttacactgttggtgggactgtaaactagttcaaccattgtggaagtcagtgtggcgattcctcaggaatctagaactagaaataccatttgacccagccatcccattactgggtatatacccaaagaactataaatcatgctgctataaagacacatgcacacgtatgtttattgcggcattattctcaatagcaaaggcttggaaccaagccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatatgctcactcataggtgggaattgaacaatgagaacgcatggacacaggaaggggactcacactctggggactgttgtggggtggggggaggcgggagggatagcattgggagatatacctaatgctagatgaggagttagtgggtgtagcgcaccagcatggcacatgtatacatatgtaactaacctacacaatgtgtacatgtaccctaaaacttaaagtataataaaaaaaatgtggcacatatacatcatggaatactatgcagccataaaaaaggatgagttcatgtcctctgcagggacatagatgaagctggaaactattattctcagcaaactaacacaggaacagaaacccatacaccacatgttctcactcataagtgggagttgaactatgagaacacatggatacagggaggggaacatcacacactggggcctattggggggtggggggctgggggagggatagcattaggagaaatacctaatgtacaggacgggttgatgggtgcagcaaaccaccatggcacgtgtatactaatgtaacaaacctgcaagttctgcacatgtatcccaaaatttaaagcataataaaaacaaaacaaaacaacagcaacaacaaaaaatttacactgacaaccaaatgaatagtcttgaaagcttaaagacccttagggaaaactgcagagcttactgaaaatattagaaaatttttgaaaaaatatcagtgaattattttgtaaaactgctaaggacaaacaggctattttgtgtagccttgaactacttcaaaacaattttgaaacatcctttaactaggtctttaaacactatttttaaattttgattataccagttacacatatgcatagatatattctcctttaaaaaataggtcaagattatattaacattcttcttaaccaccacttatctgattcccctcatggccttttacagaggcagcactattaggaatcttttgagcacagaagctaaaacttaacatagattctcctcacacagacccttctagaacaattttgctgtcactcagcattcccagtttatctgcccctttgtttggttctctgagcacttctgcaactgagaattttgtttcttctatggagtatgacctgttggtactcttgtcacttgttaacattaatcatcttcctctttgggataattatccctcacatttcttgtcacctgatgaatcccatctccagtcttcctctcatataatctcagccttagactataatcattactagtctaaaaaagctcctttaaaatccccttcccttggtgtggggggaacgaaacacaaagctcattcacccccccatcccatctacaatgcactgaccccttatgcgatggcttagctaaaagcagctgatcctttctcataccagtagtgagagtgacatggtgacatgggaaatacaaaatcccgtgttccaaaaagaaaataaatgcatagtctctgagtctgattatgaccttgatcacatttcacaatgacaaaataccaaattcagaaatgtagtgggatagagaagaacacgtaaagattcttattgtctaaccctcctgtctggcttttgcttcatctgtctacaagacatgtggcttttaggaaatgaatttcaccatatctgaggttgctgccatttaatctcctcaaatattatcttttctagtggcaagggtgagctgccactctggagtcagttgaaggcagagagtttgctttcagacacctgaatcagaatcaatgacacatccttccacactgggtgacaattattaattcttaaatcacactgctgattggggcttcagatgtctgaagccagtgccacaggattccagataatgttatagaatttcacatttgtgaagattatctccaatttttatcacgaaattgctctgtagagatgtcctgacacctgaacagaaaatacttgttcctctaaaggaagaaaaggcaaaagctcactgtaatattgtgactaatattgttctaataaataagaactcagaatttatttaaaaaaaatattttctggagcactttgggaggcccaggtgggtgaatcacctgaggtcaggagtttgagaccagcctggccaacatggtgaaactccgtctctactaaaaatacaaaaattagccaggcgtggtggtggacacctgtaatcccagctactcaggaggctgaggcaggagaatcacttgaacctaggaggcagaggttgcagtgagccgagattgtgccattgcactccagactggatgacagagtaagactccgtctcaaaatatatatatatatatacatattttttttttctggctgtcgtgaacttcactcttccttgaatttctccaccccatttaggtgggactacattagaaacagcctcacctgggagcctctgtctcagcggcacttggacagaggtctcagggaagaatgggatacagacgattattaacacaattctgtacaattccagtcactcattccaatacctcacacctcagctctcttcggctttagatttcagttcctctgaatctgaatttccaattctactttcccattgtttcttgatctctgagctcatcatttggactccctctttgcttatgtctctgtctgtctcagcttgccagcctcctagtctaaagtaccagcccatgattatttatcaccgaacaaaccctacactcttatctggcctcttttccctaatctctgttacttgtcctatcccttttgtttgtgcctatgtgcactccatgaagtctttgtccctgactgaaggctgtttcctcacttggacttcaagttttcatgatcctgattctattcgtaactaacttcctagctgtgactcttccaatccagtctcagcatccagtagtttgacagtcctgttccttcttggtctgcttgtagtcctggtttagccactgataccgcaaaaacactgggaccattggaaggaaagaccaactccaagggaacttttcccttctcacttcataaataattgggatatttttactccaggaaaagaactaaacaaagggagaagctaagcccttagcccttcagctctcctgtggcattttattcccttgtacttgggtacagtttgcagtactgaataagattacttcagctttgcaagaaaatattaaggcttaacagtataaaaattcgattagtcatgctgtgagacagctataaatgtttgtatttaaaaatctgtcatttaaacagggatttaagatgtgttaaaaaaaaagagtatctctttttaagcactagattttcagcaaactggatatctcctgagggtggttgatatcaaaatattacagggactctttctgtgtcaggtttgcttaaagcctccgaaagatggagaagaaaacagtaggtgacctccatgtaatgcttatgttgaagagcaaaaatcaacagagtgcaattctaaggcaatttaactatgttcctttatggtgtcttcaaacctgcactatatagcaactttttctccttttcccttaaatagtgtttaaggttcctcatgaattgtcaagcttatcacctttgagattatctatctttccttgtgtctgtttgccacaggaagcttgtgcatttttgccacgctagggagaaaaacaactgaacccacagttgacttcactttttgcatcaccatcatggggagattggtctcaagctgcatctacctgaatcttttctggcaaagaggaaactccagccttggtcatttctgacgaatctctctgaagcccctctcctgagcaaatctaactttattatttttctgtttctgcggacacagggggagtatattgtgcaggcttccttgcaactagattaaaaccaagaggctggtggttctaaccttggagtgtcagttgaaataattttgaatactttcaagcccactccctagaagctccattatccttttatctctctttcctcatggtggtgacctgaaggcttgtgttaagatgctaattgcccaagatgggagaaacctgagtctacgagtctgtgaatggaagggaagcttcaccaagacacactggatttctttgtgtgaagtcactaaaatttcggtttcatcttttgtagtagtaaagctaacacagtgaactttttcagccccagtcttttcatactttttagggagatactgggcaagaggttgcaaaattgtttttgactacctcctacactggatttctttgtgtgaagtcactaaaatttcggtttcatcttttgtagtagtaaagctaacacagtgaactttttcagccccagtcttttcatactttttagggagatactgggcaagaggttgcaaaattgtttttgactacctcctcttaaagttctgcagtctgtttaggtccttcctctgaaatgtagaaatcggtgccgtaaattgctgttctcaggctgctgtggcctcatccacttacacttactcctttccatgtctaaaattttaatgataaacaattttaatagtctttgtaaggccgggcatagtggttcacacctgtaatcccagcactttgggaggctgaggtaggcaatattacgtgcttatataatacgtaatatataatgatgcaaattatatatgcattattatgattaaatgtgttattgattgcaccattggttgcaaagaaatagaataatcagttaaaaacatttaagcataacaatgtattacataggtaaataatgtatgtgcatactgaattctgtatatatacacaaaataattcacataggtttataagcatatatgttctacttatatatcttgtacatatatattgtttgtatgtactatatatgtatataaacacattccaactttttaatgtgtatgtttattagattttagataataaaagttcttataattacttatttacataattgatcaaagcaacataaatatattaaaaagtttaataattattaaatataaaaataaaattttatcataaatgtttttttacatgtaaacacagacatatacacatggagtaggtatgtacattattttgtttaaattgtttaaatttttttgctactttatttatttgcaaccaatacagggtaatcaaaaattcttgtttgtaatctattaggtggcaacttgtttaagtcccccttcattactcttgaaggaaaatagttagaagccacttgacttgtaaaaggatgtattatttagttcattgtcaccatttagtttctcagtttctggataggacaacaaaactttaccaggatatagcaaatgagcaaaaataatgtcttttcttattttgtttaaaggaaccaggttcaacctgttgtattcagaaaagattggggaaaattaaatgttaatttaaatttaaatacatttaaacacattttgttgaaaaaatttgaatcaaaatgcttttgccttaccacattttaaatgtttgccctgacattatttcttgcaattgttctcttgcctttactctcatagaatgctccctaagaagcaatatactctttcataatagttgagaaatggaagaggtagggttattaaatgaaaactgctatcatttccatcctgctcttgaatacagccacgcactgtatgacatttcgatcaacaacagacatcatatgcatacctcatatgtgacagtaatcccataatattatactaccatatttttactctatcttttccaggtttagatatgtttagatgcacaaacacttgctattgtgttacaattgcctacaatattgagcacagaggcatgctgtacaggatggtaacctaggtgtgtagcaggctataccatctaggtttgtgtagttacactctgtgatgtttgcaccaagatgaactgcctaacaacacatttctcagaatgtatcctagttgttaagtgatgcttgactctataaactcaaaacattgctacttaaacaaaaataccaagtttctaaggccagggtctactcttaagacagtaagtatacgtgtaagtataaaagacatttagcttgtttttgctttctttttattgaatttctgaattttctaatttttcaaaaatgaacatatatctattatgaagaaccaagaaatcacagacagtgatttaaaaaatttgcaaatggcacaccaatattggaagaaaatctgttacatagcattgtctagaaacaaatattattgacattttctggttgaaatcttcaggtttctggccaactacagtgtaaaacccattagattagagcagttaaatgcaaatgtgaaatcatggtggagttagtctaggtttgcagaaggttgtttttataagtggtcttccaattaaaatgcatgattcacctgtgcctttgcaaagagttatgatttacatgtgtcaatactgcccattctttgcctcttttatattaatggggtagtgaatgagcaaatgaaaatttagggagcttttggagttatcaaaattagccttattaaatagtttttcttaaaatggagtttttgcaatgcagtggaacataaagtggacatggtacaatgaaattgagaataccttgagcttaaaataaggataagaactattttggtacctcagataatgccatatgtgttataatgaaaccactgaaaaacgtgttagtggcaacttgatgaaaatgaaatgagaggggggaagaaaagaagaaaataaatgaaataaaattttaataagacatctctttactttcaggtacactattgcacatttgacaaatgtattctcatcaattccccacagcaatgctagaaagtacttattgcaactttatagatgaagaaacaaatttagggaagttgagtttgtaaaaaattggtttaaattcaatcaagtagaaagtaatagaggcagacttcaaattccaggtgagtcttacttcaatgcccatgttttacccaattgtgactcatttgtttgtgaatgcacacctgatttgggttggtgattattgataaaagaataaagcttatctgaaatattaatgtccttttaatacaggtactatataatgtagaatgaccaagaagctatcatatttcaatgatatataatctgagggataaaaatgattgatagatgcacagtgtcaaagcagaaaaaatgagaaaatgttgtttcaaataagaaagtattagaatcaacaggagatgacacttatgaaaatatatacagaaaacttagaaatgataaaattaccaatcagtcttcagtaaactcagcaggcaataagttccaaagaacttctaatgaattattaaacccagacatggcgctggattaagataagaagaagctagaaaatgacatcttctaaatgatattaaacaaatgtgacaatcagcaactttgaaaatattttgaggatgttaaaggggtgctatctactttacatgtttctacatcaattatgcattttaaagtcaacttaaaaacgttcctaattaagctccttgtgcagctgtcagaggacttttttctttatttaataccaagcttaaagcctgtgataaaaacatccatgactgtaaataccaagcaaatgagcaaacgaactaaaggtgtgcccaagattctgaacacaacccaggtagcttctgagtaaagtcgtctaccatatctcaaacgcctcattttggaatttttcacaatcttattctccttcctttatttccatgtagatgtgcttctgtagatgtatgattcaattataaatgaatctaatagtgtgatattactaaaccaccaagaagacatattaagtcccagggaaggcgaggacagacatcacttagaaaaggagattatccatcaactcaatctcagcaatgatgtagggagatagcagtcttgagagcctgactgtaaagagaggagaaagttgtatttcaattacaatttctccctgaatatagcaagagccatagtgctggcaccagactccagagctttactttacactctgagcatgagaaagggataaagaggaaatcacagaaacacttctgagacagagtgtttgagggaatgaggaaaagacagaagaacaggtcagaggaatttgctgatacctaggtggcaggaaggtgtgatttggaaaagcgtgattaagcttgggtcagtagaaacccccagagcattgggggagaatctgagattgtgtgggatggttctctgcttactccttacatttgacaatttgtcaccagccagaaaggtatcagaggggaaaagatgtatatcaataaatgaatgttgatacatgtcaattctgatttcccacagcctaaggacagtgttcaagaaatccaggaatcctcccaaggggcagaagcagtcacagtcctggtggaatggcggaggcctggggccaggaccaggataacacagagctgcaacgacagtgtccacacccaactagtagtggtggcagatagacacctcaagcctgagggagactggcagtgtggactctgaacacagaagctgatgtctagagagcagcatgatgagaaaccttaatcagcagacagcaaagacccagagagcagcacatagaatggaagaccctttcaccactgctctcgaaaaaactgcttgcttttggggaataagatgacatcttgggaaagtgagggagtggggaaggagctgtgaaagactgatcatctgcactaaagagactgagttgctctaaagacgacagacttatttccagctgactggcaagacccagtggttccctgagtctccctgccagaacctccactacctagcagaatgagctgatagaggattaagtgtgttttgttttagtttaaccaagaatgaagactttctcattcctgtaaaagttcagaagtatctgaagaagaccataaataccacactccttctagatctattgttccaccatttctaggatgtcacaatttccctgatggtccaagatagtggtatttatatttcaaaaagaaggttgaaaaaaggaagggggaagaacagaaaggacatgcaccagatttccttcaaaaaaggctcttacaagttgtcaaatctaatccacttaagtcccactagccagatattagcttcatggccacatatggcttccaaaaatactgggtaatgcagaattttgggggtcactgtattagtgtgttctcaggctgctaataaagtcatacctgagactgagtaatttataaaggaaagaggtttaattgaatcacagttccgcatggaaggagaggcctcacaatcatggcggaaggtgaatgaggagcaaagtcatgtcttagatggtggcagggaagagggtttgtgcaggggaactctaacttataaaaccatcagatcttatgagtcttattcactgccatgagaacagtatgggagaaaccgcctccattattcaattatctctacctggccccacccttgacacatggggattattacaattagaggtgagatttgtgtggggacacacagccaaaccgtatcagtcaccatgactatctaaaagttctactatttcagaaaaaagacacagagatgttgggagaaaatgaggaactctgtcatagggtcatagatgtaagacactatagagggaagtgatgaccgagatacagcctggtgatgattcattagtcttttagagtttatcacacatttgaccatagcaggactgcaagtgctagcttttaacacagtgatgttcatgttattgcttgttactataggtatttcaaaaagggattaggagaggtaggtccagttctgctggcccaacactcctcaaaatcgatctttgaggttttaattatttaaaaattacacagaggaaagacgctgtttagtgtcacaaaccgtgtctttggcttattttgcaatatccattgtttttaatactactttttaggctattattcctttcagccttacagcaatcaaacataatttttcctcaattcatttcccaccagactactcactaattttccattccttcttaccacaaattctcacacaaagtggtgtttatttttgttccctgcaacctgtcggcctctcttttcattctagtgatactacctaaaaaaactatattgagacataatttcataacttttaaataactttaatgagttgttttctaactttattggtgacaaaggcatcactcacttcaagtgcataagtcagtgatattttaagtaaaatgaccaagttgtacagccatcaccataaacaagttttagaatatttccatcatcccaataagttgtgtttgctccttctcctcaccctaggtagccactaatttgcattctgtctctgtagattttccttttctggacatttcatagaaactgaaccatataatgtatggtctctgtgtctggcttctcttactgagtgtgaaagtttttgggtttcattaatgtcaaagcgtattttactacttcattcttatctattgacaaataatacttcattgtatatgtatagcacatatttctattcattcattagttgatggatgtttagattgtttccaatttttggttgttatgaataatactcttaagaacatttgtgtgtgagtctttttgtggacatatgttttcaattcccctgaatggatacctgaggagagaattccaggtaatatgataaatttatgtttaacattttgaagagcttctaaactgtttttttcagagtggctgtattagtttgcttagctgcattaacatggtactatagactggatggctgaaacaacagaaatttattttctcatggttctggcagctggaagtccaaaatcaagatgttggttagtttggtttcttctgaggcctccctccttggcttgcagatggccattctctctatgtcctcacgtagccatttctctgtgtgtgtgtgctcctggtatctctcagtgtgttcaaatttctacttcttataaagacaggacactgcgttagggtccaccctaacagcctcattttaactcagtcacctctttgaaggacctacctacaaatatagtcacattctgaggtgctaggggttagagcttcaacatgtcaatttcgggagggatgcaatttaatcataacagtggctgtaacatctttaattttaccagaaaagtgtttctagtaaatttctccacattcttggcaacatttgttcttgtccttaaaaaaatatagccatttagagggtgtaaaacgatgtcttgtggttttaagttcatttccctgacgactagtgatgttgataatcttttcatatgcttattaactattagtatatcttctttgataaaatgtctattcaaacactttgcccattttaaattggtgtttggccagcaaaactgaatacagcctcttctagtctatcttggaaatacctataatgacaaaggaacaacaacaacaacaaaacaccgttaacagtaaagataatacaccacaagaatatacaaagaaatcttacacttcaaagatagaaaaatcatgttagaaggtttctcaaatagagatgctcctggacttatgatgggattaagttctgataagcctattgtaagttgaaaatatcataagttgaatatgcatttaatacaactaacttactaaacatcatagcttagtccagcctaccttaaacatgctcagaacacttacattagcctaccattgggcaaaatcatggaacacaaagcctattttaaaataaattattggacatctcctgtaatttattgaatactgtacctaaagggaaaaacagaatggttgtatgggtacttgacatagcatttctactgaatacatttcactttgcagcatggtaaatttgaagaattattaagtcaaaccatcttaagtcagggactgtctgtacagttataacaactaaattaatcagcattttctcctatctccaaacattagttcatgagtcacttaatgggggctaggtctcagtgatattctgaagcattttctcaacatgaatacattttgctagataataacatgctatttttctcttattttcctttgccatcatatgtgatgattcccactcatgtagcactggaaaaagctgacttcagaatctctaggcagaccttggaaactaggatatccacatggctactgttggctagtcaatatgttttcagcttgtacaacgttggaccataccttgttttcaaaatgttagctattaattggttgccgacattaataaatttaattaagagattacatataagtatgtggatttatggctttaaaaaatatagacctacatgctcatatatatgaattggctgaatgtgaataattttcaatggtccctacccctctccattggtccctggcattgagtctgactgtaactaccatttatctttatgctagtcctgttgttttacttacaatgcagttaagataaaaatgacttctttatcgccattaagcttctaaatttgcaatctataggcatctaaatttgtcttccacagtctagacatcctgaaattggagcaaagtcaattatacttctaggttaactgaactttctctcaaataattccttgaatactaccatgtttaacaaaacatgctgttgtatgtttcatggtgtcaggggaagattgttttttattactgttatatccgtagctcctagagtaatgctcaaaatgtagtaagtatataaaaattgtatgatggatggcaaactaggatatgatgcaattatttactatggtccctattttcaacctttcataagcacaatcaagtttagttcttaaacgtttctcaatccagccacttctctctggtctgtacatgtaccttaatccaaaattctacctgtcttaataggactgtgaaataacctcttaaagatctttctgcctcaagactggcccttctccatactattctccacaggacatccaggatacacaaatatgctcactcctaccccgctgccaccctgcctcccattactcttggacatgagtaccaatagagttggtacaaggcatagtatataatctatagcattatttgatggacagaaaaaaaaacactcactgattcttgatggagaaaccctcttagaattctactgacatttgaaattctcatttgatgctgacatcttcacctgtggacccactgttcttggagaaaagaaaaaagctactggaggctcatttctgggaataggcccagattggctgaaaaacattgagtcggtgcttacaggggcctattttttctaccctgaaatatcaaagactatgtccagatcatcaagcttcttggtggattcccatgggttcatctcatcttgctgttggataattaaatttgggaggtggtggaactaggaaagaggatgcctcttagccagctggggttataaaccacttaaatctgccttgagcctaggaagtgaagccactcccagaagtccaggattgagggtttgtgagaccatgtatgggtttggggacaaatcttaaggtgtaatagtgaattccttagcctaatagtaattctctctcttctcctccctccctttctttctctcaactagcattgggaaggcaggcattgagaaattcacattataaatcaaaatctgttgaaaaagaatacttctatggactttgggagaaaattttcttatctgaaagaaactatagttaaaattaatcatccttcctggctggcatctgggggaaccctatgagactctgaagaatatgaatctactgctctgtaagaatattcatgatcatgaaaacaactatcattggaatacacaaagttaatctgtgtgctcaaaataggaggtactaagaacctagatttttatagtctccatgtatatttgagtctcactatatcgtttcacttgctccctttatcccattaattgtcttctttctgcttgtgattgttaatactgagtgtcaacttgattggattgaaggatgcaaagtattgatcctgggtgtgtctgtgagggtgctgccaaaggagattaacatttgagtcagtaggctgggaaaggcagacccacccttaatttgggagggtgccacctaattagctgccagcacgaacagaatataaagctggcagaaaaacatgaaaaggccagactggcttagcctcccagcctacatctttctctcatgctggatgcttcctgctgtcaaacatcggactccaagttcttcagctttgggactcggactggcttccttgctcctcagcttgtagacggcctattgtgggaacttgtgatcttctcagttaatactacttaatatatatattaagtagtatatatacagagagagagagagaggggaatttatatatatatatatatatatatatctcctattcattcttcattctgtccctctggagaaccctaatacattgtgtcctcctacaactttttgctggcaacataaactcaaaaaggtgtatataaggctaataattgttacatacgagccaccgcattttttgtttgcatctatcattttggactagatggattttgagtgatttgaggacacaagattcaatttatttgttgttgggaaatgtgaacctattaccaactcccatgctatctgggtgcaactttgctaacttttgctctattcattttttatattaaattactttctgggctatgataatgatttatctctccttttaattgttggatatataaattaatgagagaattgtgctcacatacttttcttttacatagaaaagaacatttttgagaatactttattggggagaaaaagtagatgtgttttccctgcaggttcacaatcagtaaattaaatatgaagataaatggagggaacaggactataaatgtagaggattcttgatttgaatgcaggtgaataacaccttctggggaagtacttatgggtattgagatatataacttaaaaatatgatctcgttttcatttgttgtgttttcacactacactaggtgctaaaagctcccagtctgcttctgtcattcccttattgagtcacgttaagtcaagatgaaatgtaataagcaaggtgtctgtgaactcactaggagttactgggagataagccacttcaagacatgcactgtgtcttcagattcccatcagacagcctctccctagatggctatttcactagaagccacagaaatatcccagtgacttacagtttccaactaaatactctagggaaacactaggaggactttctgcaatgatagaaatgttctgtatctgctctgtccaatgtgataactagcacttgaaatgtaggtagtttgaggaagtgaatttgttattttattttatgagacagagtttcgctcttattgcccaggctggagtgcaagggttcaatcttggctcaccgcaacctctgcctcccgggttcaagtgattttcctttctcagcctctcaagtagctgggattacaggcatacaccaccaagcccaactaatttttgtatttttagtggagacggggtttctccatgttggtcaggctggtcttgaactcccgacctcaggtgatctgcccgtctcggcctcccaaagtgctgggattacaggcatgagccacctcaccctgccagttttatttaattttaagtgagtgtaacttaaatagcagtgtgtggttaggggctactgcagtgtacagtgcagctctagagaccgtcttaaactgtttgttcagctcccccaagacaccattcacctcagtcaccaccagaagtctccaccttccagttttccatgataacccagagacttagcccgaaaatgctcttgatatttctaatctccagctcttcatcgccctccataatgccctctggatttgagttttataacatcagtaaacttccttggaacctcaacttctaaactttcttgatatagctgaagttttactgtgccacttaggatatcacttccccaatcacttccccaaccaccatctcaaatgaaggatgatttttcacctacatttcatgcactgcaagacctactttttccggtaattatcttcttagctccccagtgctgcttccatgtcacttttccacttttcttttaaaaaaattacaactacttttaagctcatgctgtcagttcatatcactaacttgtcagtcactctcccctcccacttatactcattgaagactttcatactgacttcttttccaacagcattttggtaatttcaaaattcatattgataattcattaaacacttgagtcattcatattcttgagccctttatcgataataatcttgcacctcaacaactgtctcttacaattgtatcctataactatatcatattctaaaatctcaaatttgagcatactattttctcccacattttattttttattactttttagacttttatttagggttcaagggtacatttgcaggtttgttacacaggtaaacttgtgtcataggggtttgttgtacagattattttgtcacccaggtattaagcctagtacccatagttatttttcctgattctctccctccttccaccctccaccttccaataggccccagtgtgtgttgttcacctctatgtgtccatgtgttctcatcatttagctcctacttgtaagtgagaacacgtggtatttgttttcaattcctgcattagtttgctaaggataatggcctccagcttcatccatgttcctgcaaaggacatgatcttgttctttttttatggctgcatagtattccatggtgtatatgtaccacattttctttatccagtctaccattgatggtcatttgattctatgtctttgctattgtgaatagtgccgcaatgaacatacacatacatgtgtctttatgatagaagaatttctctccaatattttatgcttttgactaaattttaaataaagtattctcacttcagcaattattccactcattgaggtctctcattccattagtgcttctatctttttcttcaatacttcaataatatctactcttttttttaagcttaggataccatgtctactgcatgtatctgcctttaagaaacacttttcaagctttactctctttccttctgtcaaaatttactgcaaatcttgggtacacctaatattgacaacaatgcttcctacctaagcagttgagcagttggagcaattggagaaaattgaactaccaaggcagcttttctcaattttaaagaccttggatcttgaatgggcacctggcactgcctggcaatcttactctatctccttaataaatatgttatctcacactctaaaggtgaccatctggcatctccttacatcttaaatttctatcttactcctttgatgtcaaccgatcatctttcctcatggtttactgagaaaacagaagcaatcagacaagctctcttccatctctccactattactagtgtatctgtgtgtgcacaggtattctgcttttttttttttttaatcctataaaacactgactcctcacttgtgtttcatattcctttcagactggcaagctgttctgatcccagaaagtcttcctctctttcttgcatcatcaacttcttactctttactggatcaattttattggtgtgtaatacactccagtaccactcatcttaaaaataatttccaatcccatgtccttctcagctattttcccatttctccaatcttcacaagaaagcctctcattactttctatatctgaaactactatcttctcactcttcactctctctgttttctgttaatggtgtccaactgagatttagtttctattattttattgaaattcctcttttgcctaccaacatcttggcatatctcagttgttaatatactcaaatattcaaaagcattaagcacactgtccacttcaccctgtgcaaaacacattttcttcatttggactttcataatgccacacttttctgtttcatccttctctgtatgctcttcctaaggctcctttctctaccctcttcttctttatatgacttatattaagggacttctagggttggtttcccttcagtgatctcatttactctcatgactttaaatgtagctgcctgaagacataaacaaagccccctgtttaaaaactatcagaaacaatattttaaataatttttttcttgttttttttttttcttttctttttgagatggagtctcactctgtcacccgtcaccccagactggagtgcggtggcactatctcagctcactgtaagctccacctcctgggttcacgccattcttctgcctcagcctcccaagtagctgggactataggcgcccaccaccatgcctggttaattttttttgtatttttcagtagagagggggtttcaccttgttagccaggatggtcttgatttcctgaccttgtgatccacccaccttggcctcccaacatgctgggataacaggcatgagccaccgcacccggccccgataatttctttacaaattatctgattaactctgtgaatatgggaaataacaatcatagagtcattttgtccctccaaaaagtattctgtttttctggagcagtttggaaataaaagaaagaaaaagaaaaaaattaatgatgttatttacccactacccacatattccataaattaatctagttttcttattaaaatattgttttatacctacttgaaataatttcaaatatataacttaaaggttattttgcagatataactgttttagtaaatttagacaagagagcaatttattttcttactttgaagagaaagaataagttttgttcacttgagacataggatttagttaaatttagtcttctctaagtcctcaaaagcagttgcagaaaaggaaaaattgacaagtgggacataattaaactaaagagcttctgcagagcaaaataaaccatcaacatagtaaacagaaaacctacagaatgggagaaaatatttacaaatgatgcatttgacggagatctaatacccagaatctgcaggaaacttaaacaattgaacaagcaaaaaccaaatagctccattaaaaatagggcaaaagacataaatagacacttctcaagggaaaacatgaaagcagccaacaaacctgtgaaaaaatgctccacatcacttatcatcagagcaatgcaaatcaaaaccacagtgagataccaactcacaccagtcagaatggctattattaaaaagtcaaaaagcaacagatgttggtgaggctgcagagaaaagggaacacttatacactgttggtgggaatgtaaattagttcagccactgtgcaacgtagtctggagatatctctaagaacttagaactaccatttgacccagcaatcccattactgggtatatatccaaaagaaaacaaatcattctacctaacaaaacaaaaaacaagaacaacaacaaaaacaacctacagtcactcacatgttcattgcagcactattcataatagcaaagacatgggatcaacctagttgcccatcaatggtgaattggatacagaaaatgtggtacatatacactgtggaataccacatagccaaaccaagaatgaaatcatgccttttgcagcaatgtggatgcaactggaggccattatcctaagagaattaaacagaaacagaaaaccaaagactgcatgttctcagtttaagtggcagctaaacattgcaggctcatggacagaaagatgacaacaatagacaccagggactactagatgggggaagatgggagggccaaaggttggaaaactgttgggtactatgctcaggacctgggtgatacaatcattcgtaccccaaatctcagcatcatgcaatatatccaggtaagaatcctgcatatgtgctccctgaatctaaaatgctgcaaaaaatacattagtctttttggggtcttgcattaattttattatttatattataaagtttctttatttaattttagtttttctattagctcaaagtaagtttgtgctttttaagtcccgtataagaaatctttgcctaccccaagattacaaagattttcttctatgtattttttggggaaattttagcttttacaattagtactataattctcatgttaaattttatgtgcagtgttaggtaaagttcatgtttatttttttcccatatgcatataaagttcttcaaacactatttgttgaaaacattttacttcctctttgaattatcttggtacctttgttaaaattcagttgactatatatatatatatatatataaaataaatatattatatatatttttaatatttgaattaaatataattatttaaataaatttttaattaattacataaatatttaaatatatttatatataaataaatttatatataaatatatatataaaaagaaaatatggaagaaaaaatagggtcctatatatacatacatatatgaagaatttttattttaacaatgactttgtaagttagtttttattttatcaaaattttacatgtgcttatttttaaaagtcaaatagttatacaagaattgtaataatactgctgcactctgcataaaacctctcactcctaatcttctcttcagaagcgataactttacaatagtttcatagctaattcttttgctatttgcctctatatatcattcagtaatttgtcaaagacataaaaattagaattataaaaataaaaattaagtagatatttaaatgtaaaaattcaatgatagggtcgaaagatagagttgaggaaatcttcagtaaatcctaaatggcatagtaatgtaaaattacaaagaagtataaaataaaagaaattctaatatatgaagaataaaagtcccaggaagagaagagagagaaaacagaagacagtaagtcatcaaataatagttctagtgaaatttgcagaagtacatatgagtttccaggttagaaggactcatcaaaagtctaagacaacagatgaaaatatatccataccagggcacttagtaataatattttagaaaactagaaaagatgtaatccttaagtttccaaaaagaacaaaagtttttatataagtgagtataagaataccattaaatttccactttagggcaaggtttgggaaactaagtaatatactttgtgtggcgacttttgtgctaaaatggaagagttgaggagttttgacagagaacatacagcccgcaatgcctgaagtatttactgtctggtcctttactgaaaaagtttgccaacacttgccttagaaatactagtgttacaagcaatagattaattacttcaaaatcctgaaagagcagtatatccaacttagaattctgcagtaaaatattccatgaaatatgagacatattcagatatataatctctcggaaatttacttctcagcatacttaattcagtttaattcattctcccttaattgcttttctgaactttctctgttccatttaacttgtacaaatttgttaattttcttaatagtcaagttacaaataaagaatttgggatatctgagcagtgattttctcactgaagccactattccttcattagaatcaattaacatctggagttaatatggtcaactccagaggtggaatgggccaccccatcaaaaatttggtttgaatgctgagattagtgacatcatacacacatcaaaaagttacgaaaaggtttattactcacataatgaggttttctgggcagaacagggaatttttcctgacaggtccaagttggttagaaagagcaggtatcagaaacaattagaaagctggcttgggtttttaggatgtttaacgggtggcactggagtgaaggctgttgtgcagaggctgggaactcgtgtggtttgaagttttcaccagtgctaaaggagagagcagacaggctatcctgtcagcttccccgatatagtgcagaaaggcaaaggggtgacatggagcttgaaagctgtcagcagtcaaatggcaaaatggaggcagaccctttttgacagaagtcattatattaatataataataattacacaaaacacattatttgaaggtggaatcttctttgtccatttttaggctacttccctctgatagtgcaaaatatttatttttatttatgccagggtactcaaaaggaaaagtacagtaacggggtaattggtataataatctgctgttattatttgatagacatcaaatttaatctgagggaagttacttatgaaatatttcataagtttttaaaatgttatagtttataagttttaaatttgtttgcaaggcagacagttccagcttcttttgtgagagctagtattaacacgactctttacaaggtaaatttttgatttgcggaagatacccagcaacttgttttctggaatggaattgtttgaagcaagtattaagagctctgccatgtttagggctgatgtcttttcatagtggaaagcacatattcaaggctggggactctgacaccttattatggtggtagcactgagcagggcctcttatgtagttatagtttttctgataaattttaaatggatataatctctaggcaatagataaccgaatcattcatttgggtcaagaggtaaggcgttttacctctgtgacaatagcatctcaataacttagattcatactttgaactattatagtatgtctatacctagtactaaaatatcccttttaactcccataggtaggttgcctgtggggtgtaataaaaagccttatggtgttcccactagtgttttacctttttattttatttatttatttttacataacacatttaaaagtagtatgagtagaatatttgcacatttaagtaatgtttctctacaaagtttggcataatttatttcccaacatttctttgttgtgtattggtagacattctctacaatttcatgtacaaaacagttcttttcattgctatagacagctaatggtatcctaagtattttccttatagtcattatgttaggctttatatatggatagatttaatcaattctgaaaacaaacctataactaaatatgaccagaagatttttcagctaactaaaacaacctgaatatactaacaatcctttttttcaattttttaatttaattttatttttagtagagataaggtttcgctatgttggccagactggtctcaaactcctgacctcaagtaatctgcccacctccgcctcccaaagtaagcactgggattacaggcatgagccaccatgcctggcctatattaacaattcttaagggaaaatatataaagaatatcagtttgtattcaaagctctttagaaaatacaattaattacaaccgttatctttcatggatgcttaaattgttgcaatttggatattagatacccttctaagttggtgtgatttagaatcaacacagagctcctgaaacatgtgtataacaatatctactagacttgcccccaaaccctgttccaaccctctaagaaattctgatttcttttagtagaggaaaaaaatgtggaagataaaattctgtgcaccaaggcccgtgtcagacacacagagctgaggcaacactattcttaggttataccaataagcaaagctagaaattatatatttttaaaaattacaatactgacattttcattttaactctaacattgactactaaaaatgtgttaacgctaacaaattataattaaatatctttttctctgataatttagttctctgtacaattaaattttttgttgaaaatatctaacaaacctgaaataattaatttgtaagttaacaaaataatgttaaagtaataataaaataaaaagcaataatattcttacttaaactaagggttttagtttttgttgcaatgtctttgaggacttagtcataaattacttgtcaaggccaatattgagaaaggtatttcctagcttttctcctacaatttttatagtttgaagtcgtacatttaagtctctgtcttgagttaatttttgtatatggtgagagtagaggtccagcttcgtacttttgcatatggctagtcagcaaacccagcagcattgattgaatagggagtcttttctctgttgcttatttgttgactttgttaaagatcagatggctgtaggtatgtggctttatttctgggttttctagtttgttccattgatctgtgtgtctgcttttgtaccagtaccatgctgttttggataccatagccttgtagcatagtttgaaactgagtaatgtgatgcctcctgttttgctctttttgcttgggattgcttagctgctcaggcttttattttggttccatatgaattttagaattaacttttctaattctatgaaaaatgacattggcattttgatagtaatatcactgaatctgtagattactttggacagtatggccattttaatggtgttgatgcttccaatccatgagcatggaatgtttttccattcatttgtgtcatctctgatttctttcagtagtgttttgtagttttccttgtacagacatttcacttccttggttagctgcattcctatgtattttattctttttgtggctattgtacatgagatcagattctcgatttggctctcggcttgatcattattggtatactgaaatggtactaaattttgtacaacaattttgtttccttactgaaattgtttatcagctctaggagccacttggcagagtcttcagggttttctaggtatagaatcatatcatcaacaaagagaaatagcttgacttcccttcatatttggatgccttttatttctttctcttgactgattgctctggctaggacttccagtactatgtttaataggagtggtgagagcaagcctccttgtcttgttccagttctcaaggggattgcttcaagctttttcccattcaatatgatattggcagtgggtttgtcattgatggctgttactatttcaaagtatgttcctttgacatctagtctgttgaaggtttacatcatgaagggatgttggatataaaaagctttttctgtgtttattgagatgatcatatgatttttgtttctaattctgtttatgtggtgactcacatttattgatttgcatatgttgaattaaccttgcatcccaggaataaagcctacttgatcgtgggggattatctttcttaggtgctgttagattcactttgctatcatttgttaaggattttttgtgtctatattcatcagtgatactggcctgaggtttttttgttgttgtttcattgtgtctctgccagcttttggtatcaggatgatgctggctttgtagaatgagttagggaggaatccctcctgctcaatttttttttttttttggaatactttcagtagaattggcatcagctcctctttgtacatctggtacaatttggttgtgaattcttctggtctgaggcttcttttggttggtaggttttttattactaattcagttttggaactcattattggtctttttcgggttttcaatttcttcctgattcaatcttggcattacatgtctccaggaatttatccatttcctctagatttcctaatttgtgtacatagaggtgttcataatagtctatgaggattttttgtatttctgtgggatcagttgtaatgtcatctttgtcattttggaatgtgcttatttggatcttctctcttttttctttaagctagctagtggtctacaaattttgtttatccttttaaaaaaccaactttttggtttcatggatttttgggtgtggatttttgcatctcaattccactcagttctgctttgattttggttattttcttcttctagctttgggattggtttgttgttttttgtctagttcctccagttgcaatattgtaaatctgcgatctttctaacttctagatgtaggtgtttagcattataaaatttcctcttcacgctgcttgagctgcattccaaagattttggtgtgctgtgtctctgttttcattaatttcaaataattttttgatgtctaccttaattttgttgttcacccaaaagtcattcaggaacaaattatttaatttccatgtcattgtgtagttttgagagatcttcttggtattgatttctatttttattgcactgtgttctgagaatgtacttggaatgagttcaatttttaaaaaatatattaagacggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaaaaaatatatatatatatatatatatatatatgaagacttgctgtatgtccaagaatgcagttgatcagtttggttcttttaaaaaatggttatttcatctttcaactcttgcaccattttactggtttccttggatttcttgtatcagatttcagcttcctcctgcatcttactgagtttccttgtcatccagactctgaattctatgtctatcatttcagccttttcaatctggttaaaaaccatggctggggagccagtgtgatcgttcagaggtaaggaaacactctgactttttgaattgttacaattatttcactaattctctctcatctgatagagctgatggtcctttatcttttagaatttgctgtcattttgatggggcgctatgtttttatattctttatttctcttgagggtttgactatagggtaagttgagtacagtcaattgacttattctgggtgtttactgaaggccaaggctctatacaggatccttatttgtggctagattcctgcactaggtttcacaggttgtgtatgcctgcaattttttttttttttttttttttttggtggtgtaattcaggttacaatccagtagatagcacttaagagtaaagtaaaggcaggcagctaggctactcacctgcatgcctcttttgtatttcagtgtgttcacagcagtgcattgtggcaagggagacaggaagggagtagagatgacccctttgccagatccgttcctgggccttaagggagcccgatcactggcactgcacctgcatttccttagccccaagggtggggtggcctgaatcgatggttaggttgccaggagacctgcagctccccagtggcccactggttctctgtgtttggcagagtcagaatgggctgtgggaaatgtccgcgggtgatctgttgaggcagtaggtcaaggacagggtatcttgaggcaggatgttgttgctgtaggtgtggagctgatgtggcacctgtggcttgggttttttttgcccaacacacagctgtggggaccacccagctcactttccctcaactgggtctccttctggtgtctgtcccagtatctggcccaatttgctagttttgtcccaagccttctacacccagatcactgggttattagatgctccaggccatgggggttccctcaggatgagtctgtggcttgcagccatgccacacccttcgcagccctgaggagggagacacacccagctcctgcaccagcctaagaacctgcacccactcttgacagtgtactgagagtgagggttcttcccatgctgaagctccagccacagatctcagctctgcactcctgagctgtgtgctgtaactgtaggggtgggaactggaccttcagctttgttctctggccccttgagtctagcaccaattatcctgggcgtgctgagctgctcccaggctgccaacaaagcattccagagaggttgactgacagagcactcaaatgaggcagtggaggtggtgctgcctgcctgctcctgtgagagggccaggcagggatccctggaggggccggtagaatcagcggctgcagatctgatgtgccctggcctctgggaacgacagccagccgtgttctctcccagcctggcagtcagcaaaggctagagccactcagaggaatatggggagccatgggggatgggcgcttatggccatgtcttcttcaattgtccaaccccctgggttccacacagggttgagctctgtctctggttactcccagggcagttccctctgccagttccactgttcatgcaggtattgagtgggatctcttgtagctaggatcctagaagtccatggtgagagtggattgcctcatggttactgtactcactacttccttaggagccattcaggcccagaaacaagtcctggcaatcaacaatcccatgcaggttcccagcttcctccctctttcacctccttaggtctgtttcacttctctaccaactctcagtgttttccttgaaagacctgcttaaaatgtgctgctttactcaatattttggtctcacttggtggaacaggctcttcctagttggccaacctgtaccccttcctcaatataattattgttgatatagttggatttacctgttttattatttagtttctgttgtatttactctcttatttttcatttccccgtttccaactgtcttttgaaattttagcatttcattttaaattacatattggcttttggctatctttctttacatatgtaaataattcttatttctatatatataatatttaattttaaaataaattaatgttaatttttaaagtttaaatttaaacacgtttaattttaaccacatatacacatttgagtaagataatgacctcagtaaattatttcaccactttttgttctttttatgagatcttaaatcattttacaagcagataagacatagaaataaagcacaaatgtaaactgtatatgtgaaattatgtattcatgtttattttaatttttatccaagaacttataataaagttcatggtctataaatttagataaaccttgttagtatgattttaatgaaaatccttaaattaccagaaagtttcattttcacattgtgtttagatagcacaccatatgattattaaatagagaaattatggatataaataggttttgaggtttctctaaattttttttaattccttttaccaaccagaactacagatgtaatttccatatatatatacattttagtgtctggctttaaacttttaaatatttaaatgtctagagaaatatataatttttttttagttcaaagtgttcaaaataaaagtaccacaaatattatttgagattttaaaggaactactttgtacaacctattaattattgagattattttatgtagttgcagatccatatttaggtgatattacatgcctttaaatatcattcagttatgataaatactttgacaacaaagcaaatataagaaatttagaaaactttctttcatttactcttttttacaaatatctaaaagcttataaaaattaaagtgccatactttctatttaatcttatgaaaattcccattagagatttaggaccttatttagggtctgagggatttggccatggtgagattgatcctgccaattctccattgaaatctaaatcacagcaaaagtttgtggggagtataaataagattttgcattataactattgctagaaagtgtcagaaactctttaatttatcattttcttagtcttttgcaaaagtgagatagataatggaagacaggcaacacaaaaaaattcttctggctttctctgacattttggggaacaaagaatgtaaagggaaaacttacatacataatgtcattctcacagtgaaattatggtcatgtacttgattaactaacactatttcctaaaataagaattgtgctctccccaagaaattctcttaataatggaggttagaggctacattgaagatatagctgttgtagtaaaatttgacacaaatgttcttggaaagatatcacaaatgacaaaagcctgcttcatgaaatatagagcagggtatggttaaatttagtcttattaggaccttagctttagcctgataaatcaacaagccaagttttaatttcatgtcagtgcccttatcaaggaaagaaggtctttccagcatacaatttgtgtgaataaagtatcttttggtctagagagattgtttcctatttgggaaatagttgtctttgttgaaaaactggagacctatataggcatgcaaatacatatttttatgtttttatgacttttactcttcacaagattataaaatattttgacataccaaaaaagtcagagcagtattgatggggttcaggatgtgctaccctaaaatatggcaccatggcatttgagaaaacagcagaagcaggaaggtcacactgactttccccttttctcccagaaagcaggtcataaaacctaggaaggtcactgtttgcccttctactgcccatctccccctaagtgggtcataagatccttaactaaaaggtgctacctctatacctagaggaaaggagcaaaagacacagagatgccaaggaaaaactgaacaaataggccttgctgagtcttcctggagtttattatcattagatcatattcttttttcctccaattgtatttctccatgcctgtctacttttcactaaactaagcacaaaacacacaagtttacaagtttctctgagtcttcattttcttaaattttaatatttaatttttgtgagtacagagtaggtatatatatatttaggggtacatgatatattttgatataggcatgcaatgtgtaaatgtgtatattggaaacattttttaaattatgaactataaatgagaaatccatcacctcaagcatttatcctttgtgttacaaaaatccagctatactcttatttttaaatgcataattaaattattattgactactatgctatcaaatactagaacttattcattctattttgtgtgtgtgtgtgtggagtctttattttcttgtgaagacttctgtatcatgtaaaacttctattaaaaattgtatggtccttttcttttgttaatatgtcttttgttgtaggtgtcttagtcatgaacatagagatttatgtagagataaatctttttttccctacaccatactaacagaacaaagaacccccatgtgccctccacccagctgaaggtctaaaatattatcaaaatagtaaagagattttgtaattctctcttatcccatctatcttcctcctccacaaaagtgactactatttgatattcatcattccccaaaatgtctttatactattttgagagatgaatgcatgaatagctccaattaaaacttcatgttggagtctttctctttgtggtataaatttctggcatgtttgcctgggttccccctacctctggagtttttttttttttcatgttttttctttaaaatctttagttggtaaataaatatatatcttcttgctataactcaactctaatatccttcaattttattctatcttttactggcattatttaattttgctgcttaaattccattgactttctcttcctatttggaccagttacttcatatttggacaattattttctcatataaatttttgtttagttatagttttacaaaagggattttgacatttgccaggtatccactaaaattcaccttagttatttggtattctttgtgccccacaaggtgtatctgtaactcatagttaggaatttcctttctttctccgtccctccctttgtccctccctcccattttccttccttcctccctccctctctccttcctccctccctccctctttccttcctccctcccttctgccctccctctccttccctccctctctctccttcccttccttcctccctccctccctcccttctttccttccttctctgtattttaaaggtagatcaagaggaggagataaaagcatacgctcatttgcagtcttgatccggaggcgtctttaaggttttctgaaataatttcagacttacagaaaagatgtgaaaatagtacaaagaattctcaaatatcctccatccagattctccaaattaacttcaatatttttacatttatattacttttttctgaaatgttcgaaagttgtagacaagatattcctttttctctaaagacttcagtctacgctgcctataaataaaggcattttttaaattaacacagaacaattattaaaatcaggaaattaattttgatacagtgctttaaactataggtagttaaaattgatcaattgcccaaccaatgtctttctattacagaggaaaacttgttttcttgtctgaggtctaatttatgattgtatattgcatttggctggttgtcatgtctctggtttacttcgaaatgctccttagatttttttttataaccttgatatattgttaatataagaggtcaattatttgtaaaatacccctcagtttgggtttatgcagtcttttttcattattagattcaggttacccatttttggcagggatacatcagaaattctgttgtggtcatatcagggaaacattaaaattcacatggtgtcatttgtctccttactggtgctaactttgatcacatggttaagatgaggtcgaggtttcttaaaatttataaggggttttacagaaagggtaatgagtagagaagtgacagttagggatgcagagctgtagcaagtactatgggaataaggagctgaggaagtgaagcctggaaagatggagtcacaggtttagacagagagcgctcgtcaacgctcctaaagcacaggcatgggtggagagctccatggacctatcaagaaattccagatgccaagcatatccagtcaccaaaggaggaacatgaggaaggaacttgggatgagctctataagatcttgtgtccacagcttattgtctgtggatccacagaaaggttcttgtagtaggtctgaggttgctactgttcagcagaatgggaactatgtggaaatagggaaaacttttttttttttggttttaggcttcctttaaacattaattgacaactatactacttataattgaattaaaagatgacattcctagggataaatataacaaaatgtgtgcaaaaattatatactgacaactataaattattgctatgatatattaaaggagacctaaataaacagagggatataccatagtaataaactgagagactcaatattgttgagatgtcaattatttcaaaattgatctatagtcaaatgcaattcaaataagaatcctagaagtcttttttttctgtagaaattgacaagctctttcaagttcacagaataaccaaaataattttcaaaaaagaaagcaaacttataggagtcaactgtcacattccaagactttatttgttgttgttaatgctacattaattaatacaggatgggttttctgtaagcagtgtaaggaagaaaaagtagtattttttcctcatctgtcacaaggttcatggctgatacctctatagcaaatgacagataaacaagagaaaagcataacaaatttatttcgataaggttttacaggacatgaaagtcttcagaaatgaagactcaaagaaatggggaaaactatgtattttgaatatgaatcaatgatacacatctatgtatctgagtatgagaaaaatcaacagtcttttagtattttgggaaaggtcaattaatctaattgaatatctataaatgacatcttttgctttcaacaacgggtctttaaggtcagctaatttatagagtggtaatatatgcttaggtttgataaagagtggatagtctcagctttctacatatggctagccagttttctcagcaccatttattaaatagggaatcctttccccattgcttgtttttctcaggtttgtcaaagatcagatagttgtagatatgcggcgttatttctgagggctctgttctgttctattgatctatatctctgttttggtaccagtaccatgctgttttggttactgtagccttgcagcatagtttgaagtcagggagtttgatgcctccagctttgttcttttggcttaggattgacttggtgatgcgggctcttttttggttccatatgaactttaaagtagttttttccaattctgggaagaaaaccattggtagctcgatggggatggcattgaatctataaattaccttaggcagtatggccattttcacgatattgattcttcctacccatgagcatggaatgttcttccatttgtttgtatcctcttttatttcattgagcagtggtttgtagttctccttgaagaggtccttcacgtcccttgtaagttggattcctaagtattttattctctttgaagcaattgtgaatgggagttcactcatgatttggctctctgtttgtctgttattggtgtataagaatgcttgtgatttttgtacattgattttgtatcctgagactttgctgaagttgcttatcagcataaggagattttgggctgagacaatggggttttctagatatacaatcatgtcatctgcaaacagggacaatttgacttcctcttttcctaattgaatactctttatttccttctcctgcctgattgccctggccagaacttccaacactgtgttgaataggagtggtgagagagggcatccctgtcttgtgccagttttcaaagggaatgcttccagtttttgcccatccagtatgatattggctgtgggtctgtcatagatagctcttattattttgagatatgtcccatcaatacctaatttactgagagtttttagcatgaagggttgttgaattttgtcaaaggccttttctgcatctattgagataatcatgtggtttttgtctttggttctggatcccttccttacaccttatacaaaaatcaattcaagatggattaaagacttaaacgttagacctaaaaccataaaaaccctagaagaaaacctagacattaccattcaggacataggcatgggcaaggacttcatgtctaaaacaccaaaagcaatggcaacaaaagccaaagttgacaaatgggatctaattaaactaaagagcttctgcacagcaaaagaaactaccatcagagtgaacaggcaacctataaaatgggagaaaatttttgcaacctactcatctgacaaagggctaatatccagaatctacaatgaactcaaacaaatttacaagaaaaaaacaaacaacaccatcaaaaagtgggtgaaggatatgaacagacacttctcaaaagaagacatttatgcagccaaaaaacacatgaaaaaatgctcaccatcactggccatcagagaaatgcaaatcaaaaccacaatgaggtaccatctcataccagttagaatggcgatcattaaaaagtcaggaaacaacaggtactggagaggatgtggagaaataggaacacttttacactgttggtgggactgtaaactagttcaaccattgtggaagtcagtgtggcgattcctcagggatctagaactagaaataccatttgacccagccatccaattactgggtatatacccaaaggattataaatcatgctgctataaagacacatgcacacgtatgtatattgcggcattattctcaatagcaaagacttggaaccaacccaaatgtccaacaatgatagactggattaagaaaatgtgtcacatatacaccatggaatactatgcagccataaaaaaggatgagttcatgtcctttgtagggacatggatgaaattgtaaatcatcattctcagtaaactatggcaagaacaaaaaaccaaacaccgcatattctcactcataggtgggaattgaacaatgagaacacatggacacaggaaggggaacatcacactctggggactgttgtggggtgggggggggggatagcattgggagatatacctaatgctagatgacgagttagtgggtgcagcgcaccagcatggcacatgtatacatatgtaactaacctgcacattgtgcccatgtaccctaaaacttaaagtataaaaaaaaaaaaagagtggatagtcatgtaaaagtgattggacaaaagggggtatggtgtaatgataattatctggggagaatttagcaagacctgtctgttcagatttttcttggtgtttttgtgttttcattccttttccccagtatagggtaagatctgtcacataagagtttctaacctactttcaagggaggtagatcagataattttttaggaccaggtctcacacagaaagttgggagaaagagagtgacttttctgcttctcctgctttctaaatttccaaggtgctatattttggagtagtgattcctgtaccctctcaacatagacatacagatcagtggaagaaaacagaaattccaaatatatatatatggcgccaattgccttcagcaaaggtgtccaggcaagtcaatgaggaaacaaaatcaattttttctacacaagatgctggaacaattatatttatgcaacagtataaaccctactgttactttacatcatatatacaagttaactgaaaatgaatcaaagccctaattatgacagcaaaaattatgaaatttctagaaaaaaccatagaaaaaaatcttgatggactcgcaataggtaaaaacttttaagtaggatgtaaaaaacatgaattttttaaatgatgaatttatttaaccaaaaggggatgataattctatagtacattatttttataccccaaaagtttgaagattgttctatgaatttctgtcacccaattccaaggaggaaaaagtgaatcaatcccataaattttcccttatttgttgtttaaatgctaaattatttataatagggtaagtattcttaatagaaaattattttgtgagctttaccatatttgagaaaaatagtaatatctctagtatctgcataatttggaaagctgggatacaagattccacttacccttaaaatttattttttcccaacatgtgacaaagattatagtattcaatcagtttgttgcataattgaattaataacttaaaaaattaggagaacttatgggggcaaataattaaaaaaatagaatacatgttatttaagtgaataatacacagagaaatacatttaaaaaaatctgttagcagataataagaaaaattatttttgcatatttataaaagctgcatgttatcttttgtctctttatggtaaatgtgcatattggaaacattttttaaattatgaactataaaatatattataatttatatttctcattaggtttaattagaatacaataatttatatttctcattaggtttaattagaatacaataattatgaaataaagtgaatagaagtataggcatatctaaaatataaagaagcgaatttaataaagatatttaaaaataacataatgtcatgtgtttaaaactatgccaaattactttctgggattttaatcacagaacaaattgatataaagacagcgcttgcccttcaagaattataaatagcatatgttttcatactatttttaattttttacgtttggcatttactttagtctgacatttaagaaatctgaatatgagaaaaacaacagtcttagtattttggaaaaggtcaattaatctaatttaatatctataaattgcatcttttgctttcaaaaatgggtctttaaagtcagctagtttattgagtggtaaatgatgaacctatcctaaaaaataccatctttatagaaaattctacgattgttttaattctcttcgaatgcacaaaataagaagtagataatgtccatgagcctgttaagtcccacttttgttgtgacatgttagggtcaattttagtggaaaatatacaaaaggttagattaattctgttttacagtgaccttcttgaaatgagagcccaaggagagctgtgcatattactccactgaccaagtgtaaaagattgcgttgaaagactgtatttacaaaaattacccatacgcggtggcacgggacttgtaatcccagctacttgggaggctgaggctggagaattgcttgaactcaggaggcagaggttgcaatgagctgagatcgtgccagtgcaccccagcctgggtgacagagcaagactctgcctcaaaaaaaaaaaaaaaaaaaaagaaaggacaatatttagtaggctaaattaaaaaaaaaatctgtacaggacccctgcttagttctagaatacattacctaaaggtttgtgctcagctagcttataacctagcagaatgacagacatactaatttaattgtaatttaatatgacaaagaatataataaatttagccagatacttgcttgagatgcagaagctagtagtcaccaagttttagaaccaaaatgcaagtgagattgctctacgtctataaattactttctttcagacatggcctttatgtaaacagaattataggcaaagtaaacatagccaaaagaaatcttttacccacttcctctcaatcaatgatttctcctcctacttagaataaaattcaaagttattgccatgccttttgagggaaacataatctggccctggctatgggtccagcttccccttcctccactctcgttatgctgtgttctggccacactggcctccggctgtttctcagataagccaacactttgttatgacaggcattttcatgtgctgctccccctgcctagaatattcctcacccagctgtgtgcatcacttatttcttcacttcagctgcttcttgctcaaagtcacctcctcagaatgccttccagaagcatcctccagaatagcaaccttcccttgcatttcccattagtcctctttccatgctacaattttctttacacttataatttgtttttgattaaaacaattctatttattattattacatcattaatacagagatgttaatagaaaaatggaaatgatcaaatgtacacttagatacacttgatatactatctgtttatatgcctgtttattaatgatctcctcattcaaatgccagttcctgtgtgcaagagcttttcacattttattcaatgtttattaattaatatggttgcatttaatactttatttaaaatagggtctggacttattagaaatgtaataaatatataattaagtaatgattgagacgcatcaccttgtcatctgtcctcatggtaaatcattaggggttatcttagacctagtgcctcaaaagagtcagaaagacttgtgtatatatccctcttctatgtcccagatatctactataatttaatacttctactgggatactgattcgttgtcagcagccttagatatgtgaagctctaagtcttgttagcactgacatcatctggaattaccaactaatttggctttgttttgacatcatttctggtaacgtattccatttcattctcatataaagtattattcactgtctccatgtcaaatcttcctacaaatttaggccaaaaaaagaaactcttaaatgctaattaagagataaattgacatagtgaagcaacatgtggaaaatgtgaatgctcaagcccaagaatgtaacttacgacagttaaggacaaaaaggagggaaaaaaaggagcacctgaagagaactgcccagttcaggattaactagaaatgaacagtgcacaaatcaacaatgtacaattttccctgtactgagaaaggaagttaaattgcgtccacagtaataggctgaagaaaagatctggaactgacctttaaaagcagactacaaaatatttcaattagtttctaatgtcaccaaagcaacaaacattttgcactgaattatgtaagatgacaactcattaacagttgactgcttgaatcaatggcaataatttccactctatttttgtataaactaattgtgagtgattataaaatctataatgagtttgagagtaaggttggctaaaagttatttctcattatgtttaaagtgatgtgggagagttgatcagcaaagctggttccattatataggggacatttgtaaactcacatttattaatcctaataggctgatcataatattttttaaatcattcagcttcaaaattaggaatctgcttagagcacggcatatatatagatacatagatattatatatgtgtcatatatataaatatgtctataaatctctcatatgtataggagatacatatataggagatatatatatgtaggctgtgctctaagcagatatctaagcagatacatatatatatgagatatatatgcaggaaatatatatatagctatatataggatatatatataggatatatatagctatatatataagatatatatgtaggatagctatatatatataggatagctatatgtaggatatatatatagctatatatatataggatatatatatagagatatatatataggatatatatagagatatgtataggatatatagagagatatatataggatatatatagagagatatatataggatatatatagagagatatatatatataggatatatatagagagatatatatataggatatatatatagagagagatatatatataggatatatatatagagagagatatatatataggatatatatatagagagagatatataggatatatatatagagagatatatataggatatatatagagagagatatatataggatacatatagagagagatatatataggatatatatatagagagatatatataggatatatatagagagatatatatatatctggatatacatagatatatatatatctctatgtatatccagatatatatatattggatatatatcctatatatatatccggatagatatatatccgatatatatatagatatatgtttatcggatatatatagagatatatatatatatatccgatatatatatatatctcctacctttatagatgtagtacaatgattctatcaagtcaaattgaaaagttgatgaagaaaaataaactcaaaattactggcaagttgtgtgatatctaaaaaactaaaaagctttttttgcagtaatataaaacaatatttacaaagagtttcaattgtcaatgtactagggtgttaacatatgttaacaccatagaagcagtatggtgtaacaaatataatttacattttatctgggatcaaattaagaaatcttctgtctggcatttactgtctctggcaagttcaaatgcttttggaaacttagtttgcttatatgtaaaacaggggtgtgtgtgtgtgtgtgtgtgtgtgtgtgtgtgtgtgtatgagatatacatatatcatatttttgtgtatatatgggtatctatctactatgatatatttttcgagaataggatgtggaaagtactgggcaatgagtagaccctgaattaaagaaagctaatatcaccacagtactaatagttcaagtattctaaatgaaagcaaaaagatactggagtatccatcaaactagttagttcctgtgtttcccctttttttttttttaaagaaacaaaagtgtaaatctttctccttaaaagagatatctttattattttaaaggtatttttaaaaataaaatttactgagatacagttccatccaaaatatgcattcattttgaatgtactttttgatatgttttaacaaatttatatacatttatgtagacaactaccacaatcaaaatacagaatatatgcatgacataaaaatgttctcttgtaccccctccaatcaatctttcttctatttccccatctcccagaacaggtaaccactgatctactattatctagtatatattaaattcttattttctggaatttcacataaatgaaatcatataatatatactcttatgactggcttctttcacttaacatatttttgagattactcatagttctttttcttaccttattccactggttacaacctccagcgaggtgcttagttgaagtggaagaacctgccttcgcttatttgcaatattaggagtaaagaaccctgtctttaatcattaagtgatattaaacgtagattttcgatagatacctgttttcaagttgaggaagttcccttcattttctcatttatgggcagaatttattataagtgtgttttgaattttgtcaagttttttttcagcatctattaagatagtgaaattgattttccttttagtttgttaatatgatgcaacactgattttaattcttgggaaactcacaagtaatgaattaatgttctatctttatcagttttttagaaaaataacttcagctattttagtgtgtgtgtttgtgtgtgtgtgcatctatgtacatggtgtgtttgtgtgtttagaggtatctcactgtgattttaatttacttgtttctcgtttgcttaaaaaataagcaatttttttgaggagtatactggccattcctataccttcctttacgaggtgcctgttgagtctttaccatttaaaaaattgggttgcctttttattgtagttgtaggagttaattacatatcctgaatgctagtctgctgttgaatacatatgttacaaatacattcttccagttcatggcttttctgttaatgttgtttttcttttttcttttaaagaggcttattctgagtgaccaagggctggtgaacagcctcaggaggtcctgagtaagtagtcctgaagtagtcgggttagtttggttttatacattttagggagacaagagttaaagcaaagacataaatcaatacattgaaggtgtacattggttcagcccaaaaaggtggggcatcttgaagtgaaggtgggttatataagtcataggtggattttagggattctttacttgataattggttgagaaagtttgtttaaagatgtgaagtcaaaaagcagaaacgcttgagtcaagataagggggctgtgggggccaaggcccttattacctgtggatgaagcctcatctgcaggtgagcaggcagcagccctcagagggaacaaatggcaaatctctcttcagatcttaaaggtgtcagactctcagttaatctctcacagatctgggtaaggcctagaaaagaaaagcacggctacattaatagaggttctctacagatgcaaatttctcctgcaaaagacagttttgcagggccatttcaaaatatgtcaaagaaatacatgaatattttggggtaaaatatgttggtttccttcagggtctactatctgtcatgtgatgctatagcagagtcaggtcagaaagtagaccatattatactgcattcattaaaaaacccatttcaggagattttacagtttgcagggaatgacttaaccctttccttgcatggccttaggtcttgtttataatttgatgtcctatagccacaaagagtctgttttgtcagtcttaggatctctactttaacctaatgctggtcagtgatgcctgtactccaaaagggagagggtataactaggcatatcttcttcccttctgtcctggagaggaactctgtttttcaggtttctctaggttccctgtggccaagagggggtctgttcagtcagctggggaggataggtttaggattttatttttggtttgcaacagccagaacttcagaaatagtttagaacatttacactatcttcagcattttacttttactatatgccaaggaaaaacataacttgagatttaatttaccaaaaagagtggtccaggtggtaaactaggtattaaagacagttttgcagcaaactcttttataggattgtcagcttcaaattacagagcttcagatgagtcaataaacaggagaggaagtcattgagagaattataatagtggaacctggagaccaccacactgcaaagggcataatggagccagcgtgctcagggacggttgggatgactcccagtgtgcttcgccattgtagaaaccgtacttgtgcaggggtccgtagtactgggccaccacgttgtaggacctggtcccacagacatcggtcagcaccagggaatggacataatccttcaggtcagaggctgtgcatatgcccccagggaagcacagctggggcaaagcaaggagttccatgcctcctgggacagtgacatcttcaggatctggcactctggggacactgggaaggccatcttctgctctggttttgggcttctcttttttctttctgaaggagtggcttcttgattttaccaagagtggtgccatttgcactggcatttgactgtgtgtgtgtttttatttcttcagtttttgagacagggtctttctctgttccccaggctggagtgcagtggcacaatctcagttcactgctgcagcctccacctcttggggtcaagcaatcctcccgtctcagacgctcagctaatttttaaattttttgtagaaacagggtcttgccagattactgaggctcgtttcaaactcttgagttcaagcaatcctttcgccttggcatctcaaaatgttgggatcaccgatgtgagccacagcacctgaccctgtcctctttactgataaaaggggccacaaaaacagacaggacctctggatcaaggggagaaatagttttgactctttttctgagaaacctgctggaggccttggaggctgttcccagggtgtccagcagcatccagcgctccagcagcccccaggatagcaataggtgctggggtacagtctcttcctcagctgccccatggcctactggggtaccacccttgggtgcctcgggccatggctccaactattattatttttttgagatggagtctcgctctgccacccaagctggagtacagtagagtgatcttggctcactgcaacctcctcctccccggttcaagcaattctcctgcctcagcttccctaagtagttgggattacaggcgtggccatcacaactggctaatttttgtattcttagtagaaatggggtttcaccatgttggctaggttggtcttgaactcctgacctcaagtgatccacccaccttggcctcccaaagtgctgggattacagatgtgagccactgcatctggccacattatagtaagtctttgaatcaggtaagtcctctgatttcgttatttttcaagattgttttatctattgtaggtcctttcattttcatatacagtttagaatcatcttgttagtttctaaaaaaacggcttattcaaattatgattgggattacattcaatcccaaatttggagagaattcatatcttaatattttgactcttccaatccttgcacatgttattcccattttaaaagtttcatttctattatttcaacaatgtttgtaattttcagtgtaaagaccatacacatttattcctaagaattatttgtgtccaattgcaaacttctaaaattgtattttattgtgaattgatggtacattggaatataattaattttatttatgaactttgaatcttacaacactgggattattgacataatttctatatttgttttgtagattccttaagggttttgcacatacatattatgtcatctgcaaataaatattgttttatttctttgtctaatctttatgtctatattttttttcttactgaatcacctgggctagattttctaatgcagagatgaatagaaatgatgatgactgaaatccttgccttgctcatgattgtagtaggaaagtgtttattatttcattattgggtatattgttaggtactgtggggcattgggatttgttaacctgcaggatagaagtaagttgtagaaaatgttttaaaaataacaatgctgaattaaagttacttagagattttattatcataatacgaaagagattctaaaccaggacagtgtgatgggctgaactgtgtccctctgaaaaaaatacattgaatctctaacttcaacttccatggaatatgaccatatttggatatagggcctttaaagagatgattaagttaaaacaatgccattagagtggactgtaacccaatgtgcctggtgttcctataaaggaggaaatttggatgcaaacagagacaccaggggtgcacatgcacctagaaaaggccattgtggacacaagccaagaatatggcctcagaagaatcaaatctgcctacacattgatcttgaactttagcttccagagctgtgagaaaataaattcctgttgtttaagctatctagtctgtggttgtttgtaaaggaagcccttgcaaacatatacagcctgtgataaaattctctttttagaatgaaagttttttgctggtttagttgctaaagaatttctgtggttaaacagtcaaattagcacatttctattacttatcctttaataaacagtctagcaaactgttaatttaacaaactcctagttatagaggaggtccctaacgaactagactcggctacatagattcatttcagtaatgagctttaatgttcaagattgtttgaattcacttcagctataattagtgtttccaaagcctgtgaggttacatatttctggacttaaacggggattcaaaacaatgacagcacaattgtcgcaaagtcaaacaaaatttgagtcacttaaatgcccttatgtgaccttttattttattttttcatgtttaaccttttattcggacattgaaaaaaaattattcattctctatagtctcaccttatcgtggaaaatgctgcagaattatgtttatataaagtgaaaagattttccaggtaagatagggtgatcattatatcattatagagtaactccctcatgaatattaatataaccatgctttaaaatcattaatagtttttatttttattttgaaaggacatttttgttggttatacaattctaggttgacagtttcacccttcagtactataaagaaattgttcttttttttttcaggcctccataatttctattgacttcaataatcatttttatctgttttatgacatgcaacattttttgttctctgattttgagatttaatctttattcttggatatcagcagtttgactacaatgtttctgactgatttgtttattctgcttagtgttttactgaattttaatatgtggtttgatatattttatcaatcttgaaaaattattggccattatctccttgtgtgtttcctttgcctcattttctatctcctctctttctgagtctgattatacataaggtagtttatttgatattgttccacagatacagcatgttttgtttttctaccgtttcttctccttgtatttcagtttagataatttctattgacccaataaaaattatctgctttttttccgtaatgtgccagactactgataagcctcttgaaagattttctcatctctaaaatcccattttcatttctatcatttccagtggattctattatacagtttccatttctctactgaaattctccatgtattcatgcatattgtccacattcacaatatatcctttaacatatttatcataactctaaagactgagtctggttctataatttatttcatctccttttgattggccatattgttttgattcttttcatgacttatttttaattgtataatgcattatgcattaaaaatcagaaaagacttaagtaaatgattatgcccagaaatatacataaatgagccctttttgttggagtgcttgtgtggaaagtggaatccatctaatttgtagctaagatgggtttaagttttcttggtgttttaagtagatttgtacacggttgtctttaaataatatgaagacatgctgaagacctcttcagcagagtttgagatgagaaagcctggtggttctatcccagtcttatttccctaccctcaaaacttctacagatgtagtgtctatgccttggaaggggtctcttagctctcctgccagacacatgtatcttctattattcaatggagttgcttctaagcttttccatcatattttctctgtcctccatctttagtaaatataagtaaattttagaaatgtgtttgtattctaagcaattcaatgagtttaaaatatgatctcataggccagacacagtgactcacacccgtaatgccagcactatgggaggccaaggtgggtggatcacgaggtcaggagttcaagaccagcctggctaacatggtgaaactccacagctgggcatgatggcagatgcctgtactcccagctactcaggaggctgaagctggagaattgcttgaacctgggaggcggaggttgcagtgagctgagatcacaccattgcactccagcctgggtgacagagagagactctgtctcaaaaaaaaaaaaaatatatatatatatgtgtgtgtgtgtgtgtgtgtgtgttacttgctagatctggctctgtctctctctctctctctctctctctctctctctctctatatatatatatatatatatatatatatatgaatttacagttatcaagcctgttcttaatgttagcctagggacaagtttcttttgtggctttctgtgttctaagtggatatgaaagtctcagtataattttttttcatgaaaataaatccttgattttaaacagattcatttatctttatttatctttttaaataactactttatgattagtgttttgtgttatgtttaataaatctttgttttgagtacacaaaaatattcatgtctcttttttcgtaagagcttatttactaacaacaactttactcaaatctgaattgcagatgacccttgaacaatgtgggggttaggggaactgactcccccatgcagtaaaaattggtgtaatttttgactccccaaaaacttaaccactaatagcttactgttgactagaaggcttctcaataacatgaactgttgattaacacataatttatatgttacatgtattatgtgctgtattcttgaactagagaaaatataattaaaaatcataaaaaatacatttgttacttattaagtggaagtggatcatcacaaatgtttcatttgcattgtcttcatgttgagtaggctgaggaggagggagcaaaggagacagcattgaggagggagtaaagggagcaaaggagacagcattgtttcgctgtctcagggatggcagaggcggaagaaaacgtgcatataagtggatccatgcagttgaaacccatgttgctcaagggtcaactatatacttaaaatttgagaagaaatgtgtcagtttgatggtttagatattttgtgtttaatggaggatggagcatcttccccatgtatatatttgttgctttcattggatttgtggaaaggaacaaacaatgcttttactttgcttcttttaatcaggatctcttttattgctaaatatttttaaattgtaataattctttaataactttagaattatatatgactatcagtattaatgaagatattagcatcactattctacttttcagcagcaaaagaatttaaaatagaatattgcaccccagtataaatgtagtcagaaaggaataaagtttgaaaacttaatacaactatatggctcaagggactttattgattttccctctcgaatcagtcaaattccaattacacagctcattctgaagtcatataaagcaatccatctgactttggtgttacttgccagatctggctattaaaagaaaaaataagtcattaggctattcagaatattagtcccagttaaagaccaatttctgttggtgtataggcctatgtaaagctatgtttataggagattaatattttagagggaaaatctctgtggtaattcattttaatcttttccagcatttgggagatacagtaagtgacatgcactagatgtgatttttttatgctgtttaaaggtgattggtttaaatattattttcggtaaatacacacgcgggagtgaagaaaaaatataaagaactaaatccttataatcataaaataacttaaaaatttttagaagtaatttctcctttgcttccttgttcttataattaaatacagtgacttttagctaaagtcacataatcttttaaaagaaaacattatattgtgtcacaaaggaagagaatatagggcagtttgtttctgcactaataaaattaaatgtagcatttttatacacaaagacatgtttttatctttgacatttgaatatctctcatgagattatattaaaattctatcatctaaattgtttatcagtgagaaataatatttactctttcaactagcatttatataatgtgctattagtactaagctttcccagagagacagaacacatgacaaggtataatatagttgaaaataaaacacacatgcacacacacacacaattttatattgtatcaaaaactttaaatcaagctactaatgctttcagaattctaagagtacaagactagtcaaaattgaaaattagaaattaatctttaattttctaactattatcataaaggtttatagcaactgagtagtcagagtggtttgaaagtgacatgttatggtaggcagcttccaaaagtgatcctcaatggtcacctctggtattcccatcccattttcttgagcgtgagccggacctactgctttgcttttaagaagcagaataagataaaaattataaaatgtcactaccataattcgtttacaaagaactgatttgatctggttggcattctctatttcttctcagtttgcacactttgactaaaaaaaaagaagcatgctcatggtaccaaggcactgacagtggcatctggccaaaagccagtgtgcaattaatgctttcacatcaacagttcatgagggactgaatcctatgaacaaccatgtgagtgagcctggaagtagaatcttcttcatctgagccttcagctaagactacaaccctggcaacatcttgattgtagcactatgagagaccctgaggcagagtattcacttaaaccatgcccaaattctggaccaacagaaactgaggtaataagtgtttgtttttcaaagtcttgggttattaattcattgtgcaacacttgatcactaatacagatgaaaagagctggaatttagacaaatgagataatgggaatgcgcaggatgaagaacattttagatcatggaacagtatgaacaaaggcaaggaaatagaataatcattaggctaaaatgagagagtgtgccatggaatactgaggaagacaaacacagatataacagaattttgcaagccaagactatgaggacatattaggaataatataaatagcaataatagatgacttagctgattgatattatgtactaatttgttaagcatttcatgagcatttccttatttgatccttacactacctctatgagaaaaagatatttattattttacttatagatgagaaaacgggggctcagctcatttattatgagcagttttcatctggaaagatcatgaacacggtgctttttctagtactggcacaaatatcttggttttaatatctgttcaactgtttgaaaaacattttgattatcttaatacagttttgtgatcatgtaaagacctcttccgtaaaatactagctacttataattattaatgctttaataattaagacacaagcatttaagagattttaaactgactcagttaggttgaatcaataggaattaagtagttgctcacattaattttccattaagatgctctttctacttctatatatttatctctaggaagcagacataatttttaaaaagataatatgtggggggcatcttatcaattggttgtttatccatgagttttcacctttcatttgtcatagtgactcactgactgccaaacaaaattaatattttttaatatgatagaaacaaatgttaagaagcaaatgtgtatgaaggtttataagaaagcagagaggaatagtgtctctaggcttccaatttaggaattccatgtcacgatgagggcaaaatttaggttttgaactgtgagagaattacagacagaagaaacttttctttgcaaaatgtaaattcagagttttgagattagggaaatagaactcttctaagtgatagagtaaacaaattgagtttatgggtagcttaaacataggtagataaaaataactaattgatttgaactgtaagtttaggaattaaggtgtttaaaattttatttttattttttaaaagctgataataaagttgctttaaattaaggctaaacgtgaatgtagaggaagattttttaaaaactcaaatgccaacaagggcattctctgtcgaattcataaaacaaatccttactatcatcttcttatcaatgcatatataatggtaacttgactcaagagagttgctcagagtttcagaaatatagaagacatcttattactgtagaagctagttaggattagcttatgcattattcatgaaatgacagggacattaaaaggtaagttaagttggattatttatcttagaggtattggaaggtaatcttttaagactatgaaatactcagcaatatcttatcattttactatgaactgttgcaaatacattttgtcttcgttatggagatagacttgcatgagaaaaaagaagctatggaaaaaaagaatgttaagttttcaaagtaaaatgtcaacattttattcaatcttttcattatgaatattgcacttgtttcccaacggtcactcattacttttccattcatgtaactaatcagtcagtgtgagaaattgaagagatacatttaaacttttcttcacatgtgaagagagctgacagtagcagtaatattaaataaaatcatgggatttagaataaatgtttcattgctttaaagatggcagagaggtcctgattgtgctctgccaagtgaaaaatacaagtaaaatttctactcttgagagcagatttatcttgtgcaaggcctatacaaatctggaggaattttatttttgcctatttctgataagctcagtgctgcagttttgaaatttggtgactgagttttattagtgaagatgtgttgcactggcatcctgtgagaattttctgtatacatacatatgcagcacagcatgataaggtttatcctgtacacaggggatggctcttttagattgggacactgggtgtatcctcccgatgactacaatcttactctggtagtcagcatttaataccaggtggtttcctaagacacctttggaagaatcgctaactctttgcaaaatggggagtgagaattgttgagttgagattgttttctccaggaatctaaactcccatctaccatgcctagccccttaggcaggataaagcttgtattataaaatgattttttgtaaactatgagttggacactgtaccatcccaaggtagcatttggggattcctttccctatagccttctcaaggggtggctgttttcccactcacaatcctccccgaactgttcctaaaggtaggacaggtaccatactgcttttccttgccacttccaggccactctttccctcctctcccaaactcccagcactgagtatcttgtcattagattttgcaatctactgtcctaattatgactgccatctactgatcccaggttattttgcattattttatacacttttaatttctggatcattgtcattctttccagtacaacttcaggcttaattctgggtgactttgaaatacatgtagaagatttttccaaccaccttgctggtcagtcttttcaatgcctcttctccaactgtccttgtcttgtcttcttcagtcatgcattcctatgatcatatagtagacctatgtcattactaataactgcaatctgttcacggtctaaattttatccctcctcctaagttttcaatttattccctctgttattctgatcctgataatatttttactccagtaagacctctaattcattggttctacaagttttctattgttcttcagccccttcatgttctctcttcttactgagcatacatcccatgggtaataaatctaaccactcccttgcattctcccgcaagcccatcgtcttgtcttactcaactggcaaaaccacagtccttggctactctgtggcatcactcatgttgctgatggtggctgaagaaaaacatgcagataagttgggtattcccactgtgagacccaaatgagctatgaatgctgcctggcagtcataagccatttccctaggttgttgttttctttcctagattgatattttctaccttctgccctgacttcagactcgagttctccttccttttattttctctcaactgattactttcttcacattttcactgagaaaattaaagcaatgagaaaagaacttacacagattgccaccatcacacctattacttcatagcacctgcaaccagacgatctgcttccatgcctgggattgaaatgaatggttcctattgccatctaacacggacttttccaactgtggcagtttttctttctctctttactcacttctgttgttgtgcaaatatcgcctttgaaataatacctacagaaatggtgctctttaaaactccaaattgcctccccatgctggcaactgatcttattggctctattttcatagtatttgtcaccttctaacacactatgtaactcactcatttattataattatttttataaaatatgttctcttgctagaaagcaagctctcttgaaggcagggtattttatgttttattcattattacatctcaaatgtctagaactgtgcctgcaggaggtaggcagtaaatactttccactgagtcaataaagtatggttcaaaatgatgtgagccattcaagatgggaatcattgtaatataagaacatattggtcatgttgctgatttttaaaaaaatccttcctatcttgcagtttttcacctagtttggaaaattttttaaagttatatttttatcttttggggggttataaacagggtcttgctatatttctggctgtatatattctatgtagtaggcctgccttgaactcctggcctcaggtgatactcctgccgttgcctcccaaagtgctgagattacaagtgtaagccaagactatttccagccaaaattggatttcttatgcatccactttatatataaaacacataatctacacttataaaaattatttggtcagagacctctcctatgacacacttaaagcatccttcaacaaccacctaagagcaaaccacttaagagcacctgcatcctttgctcctgtacttgactccctccatattttcttttcttttagaatgtactgtgttttagaatagtctcactatgtactggtcagcattttatccttatctatgttattccaggttatttgatgcagaaattgatgagatattctaggctgacatgagattgtgttttatatacacctagatgatatactagactgcttactccagtactccagtacttggacactagaaaaactgctagacttcccaaagctgtgatgtccccttcactcattcaaaatttatgattcaacatcactgaggctagtgatgcttttttcttcttgaactatgtgactaaatttaggggaaattttatccttctcaccatttccttgagtttataaaaaccaaaaatattttaaaaaccacatcattatcttgcctgacacagaaaagcctttgataaaatttaacaatgcttcatgttaaaaactctcaataaactaggtaatgatggaacatacctcaatataataagagcaatttatgacaaatccacagccaatatcatactgaatgggcaaaagctggaagaattccctttgaaaaccagcacaagacaaggattccctctgtcaccactcctattcaacacagtattggaagttctggccagagcaatcaggcaagaaaaagatataaaaggtattcaaataggaagagaggaagtcaagttgtctctgtttgccaatgacatgattctatatctagaaaaccccactacatcagcccaacagcttcttaagctgataagcaacttcagcaaagtctcaggatacaaaaccaatgtgaaaaaaatcacaagcattcctattcaccaacaatagacaagcagagagctaaatcatcaatgaactcccattcacaattgctacaaagaaaataaaatacctagggatacagctaagaagagaagtgaaggacctctttaaggagaactacaaaccacatctcaaggaaatcagaggacacaaacaaatggaaaaacatttcatgctcatggataggaagaatcaacattgtgaaaatggccatactgcccaaagtaattaatggattcaatggtattcccattaaactatcatttatatccttcacagaattagaaaaaaaaaactactttaaaattcatatggaagcaagaaagagcccgtaaagccaagacaatcctaagcaaaaaagaacaaagctggaggtatcatgctacctgactttaaactatactacaaggctacaataggcaaaatagcatggtactggtacaaaaacagacacacagagcaatggagcagaacagagacctcagaaaaaagaccacacatctacaaccatctgatcttcaaccaatctgacaaaaacaatcaatggggaaaggattatctatttaataaatggtgctgggagaactggctagccatattcagaaaattgaaactagaccatttctttacaccttgtacaaaaattacctcaagatgaattaaagacttaaatgtaaaatccaaaactataaaaagcctagaagaaaatctaggcaatgccattcaggacataggcatggggcaaagatttcatgacagaaacattaaaaacaattgcaacaaaagcaaaaattgacaaatggtatctaattaaaataaagagcttctgcacagcaaaataaactgtcatcagagtgaacaaactacagaatgtgagaaaattttttttgcaatctagacatctgataaatgtctaatatccacaatctacaaggaacttcaacaaatttacaagaaaaaaaagaaccccattaaaaagtgggcaaaggacatgaacagacacttctgaaaagaagacatttatgtggccaacaaacatatgaaaaaaagctcaacatcactaatcattagataaatgcaaatcaaaaccataatgagataccatctaatgccagtcagaatgattattaaaaagctaagaaacaacagatgctggtgaggctgtggagaaatagaatgctcttacactgttggtgagagtgtaaattagttcaaccattgtggaagatgatgaggcaattcctcaaagacttagaatcagaaatgacatttgacccagcaatcccatcactgggtacatacccaaaggaatataaatcattcttttataaagatacctgcatgtgtatgttcattgcagcattattgagcaaagacatggaattaacccaaatgcccatcaatgatagactgaataaagaaaatgtggtacatacacaccatggaatactatgcatccataaagggggatgagatcatgtcctttgcagggacatggatggagctggaagctattatcctcagcaaactaatgcagaaacggaaaaccaaacactgcatgttctcacttataagtgggagctgaacaatgagaacacatggacacagggaggggaacaacacacactggggcctgtcagagggtagggttgggggagctatcaggaagaatagctaatggatgctgggcttaatacctaggtgatgtgttggtaggtacagcaaagcgccatggcgcatgtttacctatgtaacaaaaccatccttcattatcccagaacttaaaaataagtgtcttaataaaatagaataggtctgataattaaaaatatttttaagtgttgccatcactatctttttaacttttaagattcaggaagtacatttgcaggtttgttatatgaatatatagcatgacactcagatttggggtatgattgatctcatcacctaggaagtggtgatagcacccaataggtaacttcaacacttgttcccctccctttctcctcttgtattctccagggtctgttgttccatcattatgtccatgtgtgcccagtgtttagctctcacttataagtaaaacatgtggtacttgggtctccatttctgttagtttgcttaggataatggcctccaactgattccatgttgctgcagatgacatgatttcattcttttttatagctgcatagtattattccatggtgtctacataccacattttttttttagtctacccaccattgatgggcatttgggttgattccatctttttgttattgtgaatagtcccttcacattttcttttaggagaaaagagttgatcttaaaaggcagatttattctttcatagataaaaattgtgtgctgttagccatattctttagatgagcaataacttgtagaatatatattttaaaatgtgtagatgttcttgtttttaaacaaagatttgttgatatactttaatttcagtcactaagtccacgttttagtttaaccataattttaaaagggctattttatactgccatttacaacacttgcatataacttctcttattctttcctcattctcagctatgtaaaatgttttgcagttttaaaaagagtgtctttaataatatccagtattacctaataaacactttattataataatcagaaagatcatctcttaaaaaatattccttaagtctatcatttcattcactcaaatcagttcaaactgttgcccccccaccatgggtacatttactacctaatagtgttttccaaagtactattaatattttctgattatgcagcagaaatctacaatgtccctggagtcaccaaacctgccttaattgatgtgtgcgcaaggtaagctaaaatcagacacgcatttatcacagctgaagtattttcttctattttaggctgaagtgtgcgggagaggacaagtgccgctccaactccctcacatttgcaggcagtctgcatgcgtgggagtctccatcactcacaaggtcacggaatcaggagaaaaagggaccagagccgtgtgtgcccgctccagcttccctaccctcgcttctcgtcagtgttctttcctctcttctggtcacagagtgccaccaactgtccccctgatggcttcctggatttctgtgaactgatctaagcctcactttcactttgttctacggagggctttttcagtcgatctcctctgattcttccctgctcacctcctcaccagaaaaaaacataagtgacgggtgagagaatggtaataaaatattcttttctgtctttttcaaaggcaaggtagtagattcacaaggtcagagttctgcatttttttcctaaaggacttcgattaagttccttgaggtatctgcagtgaaataagtatcaactgaaagctttatggtttttgaaactttacattactttttctcctacagcagcttcattaagcccgcttgctatttacctctgacttgccaccctgtagggctgtggaaaggaattaaattagacctaattagatactggaagctgcttcatattccattaataaaaggcttcctacttggagaaaatgggatttaaaatgtgtgaaataagcatattatagagctgttcactcactggctcaatgccacatcagctttttagtgctactgtttctagataggaaatagggaactgcacaaaagtacaggcaactgcctatattggtatagtatgaaacatgttccaaacttctttgtctataaatctctttcccaaggactctaaaattctctcctttcttgatttgcatgattgagacagtgaagtcaactcttagacaatgatatttgggcacatttaaaatacataggatcagtcatttagcttaaatgtgctgatgagaataaccggcctcgagggaaaaagacaaaatactataaattttatgagattagaccaagcatggaatcagaaagtgttagttttgaagagactctggaaaagggtagcctggtaacaaagaagctgacgaccttgaatgtttttgagaagagaatattcaacatgagttggagaggaagcagctgctaccgctacatattccactgggcagttattcaatctagtcattttcatgtgcatttaaaaagtatctttatggtcaattttgtctgagttttttttgttaccaataatgggggtgaatttgacactgcttccaaaatttggtaagttaccaggagaggaaactggaagttgtttgaggtcagaaaaagatcaagaaggaagaatagaaacattgattagcatcaggcattcaatgaaggcttgttgaggaaaagacagatgaaaggcagaaaaaggaatgaagggaagaaggaaggaagagaggaaggaaggaaggaaaggaagaaaaaaagaaggaaagaaagaagagagagaagagaaaagaggagaagaaaagagaagagagaagaaagaagagagaagagaagggaaataattcaaactcaaagggcagtgttagtggccacagcagaaatggaaatgaaggtgaattcagcgagagttagaggccagatcctgtaaacctagtataaaaaaggcaaagtaagccttttctttcccaaatacaatctggcagtaaaccgtccaaagtgaggctcagctggtggaggctgaggggctgtgtgggggacctggaactatgacttactgcgttctccttgacagctccctgaagcagaactccgaaatcccagagctctgtgagactccattaaaactcactgaataagttttttttccctaagattatttgagaccagtcttgctttcctttaggattcagtaaacacttgtttctatggcaaagagtgctgtgtctcaagttcataaacatatttctatcactattttaaagggttagattcctaaaagagggattgtgacggcatataattaacattagtttatccataactgttagcttatatttagacaactaaaatcccaaagcctttttatatactgtactgccaaatcagctctccctcagttggtgtttgcataatgaatactttgatcataaatggaagttttgctaccaatggagcaactggacaatgtggcttgagtatttgaaaacaataacccttctaatagtttcctccaaaatcaggcatagtgttaccccaaatcaggtaatgtggaaaactacatgactttctggttagggtggccccacatcactccctgcagagagcagaggtgtatacttgttctctgcaggcacagaaatcctgaatgaagagcaacaagataagaagggtcagggctatagatgcctcattcttccgtcaattccacctgtcaggtaaatcacttcctttcctttcagaactgacttaagtggaaaagagaggctggagtagaattctgatggggtctttccacatagagacataatgccatgataaaggaagttctccctgctagattgatcttgaataggagctcagacatgaggctggtggtagggagtggaagtggagtcagcccagagaaggaggcattttgttacctaaggggaggagagacagcacactgacaaatatgagggtctttatttaggattgtgtcactcacgtacatctccagaataatattctactagctgtagtcttacgttaggtccccatagttgcccaactgtgtccttatctgggcctggctttctaggtattgccagtcctgtagttatccaatcttgagcataatggatctatttattttgaaatacccccaaggttacgtacaataacgtattcctgagtgcttctagggatgcagacttcacaaatctttatttttggaagttatcatacatgttttttcccttgaaattttgacatttctgttttccactgttgtttcagaggctgctaaagtatcactttcttactccataccctaaatgaagttgatatagaatggaacacttaaatgcttttaaggcttaacttccataacattaattgactttaatctatatgggcaatatttacctgtaattactttaaatcaaaataatgtgagcacttgacaaaatatccactactatatcatgaatggcttttgataaaaggaccactctcctgctttatacctcctaatcttcccactccccagaagcaacaactttttatcatttatgttttcagcttctttgtggctgcctccataactctagataatgtttacaccactgtttctgaacttaatctctttaaacagaatcccatgccttaatgccttcctaccttgaaagatgaaaatttagctcatctcttcttggcccacattcttctccatgttcttgctacttttactgttgctttcgtttctagtttacttatgtaactgtaactagctgtatttcttgttcccatcattttaatcaacaagtgatgccattttataggagatgatgacttccttccctattgcctatttcctattactttttacattgttagggatgttaacactttctataaatctgtaattctttgtattatgagttgactatgaatgttaaaaatcaatagcttttatgtgatttttgcctacacaagataatatcgttcatattttcaatatctttggcttttgttttataatcataggtttttgtaaagtttttcttctagttcatttcataagcatatttttaaccttttagtgtttgttccctgttctctgcctattccttttgatagcatttgattcttattttatgaattaatacattcttacatgtcttgtgtacactgattagatttttttttttttgcttttttttttttttgagacggagtatcgctctgtcacccaggctgaagtgcagtagtgcgatctcggctcactgcaacctccacctcacgagttcaagcgattctcctgcctcagcctcccaagtagctaggactacaggggcgcaccaccacacccagctaatttttgttttttttagtagagatggggtttcaccatgttggccaggatggtctcgatctcttgacctcgtgatccgtccgcctcggcctcccaaagtgctgggattacaggcatgagccaccgcacccggcccactgattagatttttaagctttttcttgaattatctctactttctcagaaatttttaaaaaatgattacttatctagttatttcttcttcatggtttttgttccatttgtgttcatccttggttattcacacattttgaagaatgaaggcttgtgtaaaccacatacatttgtttacgtatctccttgagtataatcctttattagctaggtcagttggctgtaagaattaataggttgctggcttctaaaatgtaaggatcagtaggattttgtcccattattccacccgcctcacaagaaatcttagatcttctcagcttatttgttccgttccttagagatgagtcctccatgtcttgcctgtagttaaacctcgctgcttgcatttgaattgggaataagaaagagcaatgaagtgttcacatacaaatcttctattacgtctcctgttttaagctttccctttccctcccagcctccagcatgctcactgagtctcagcccagagcttctctgtaatcaaggggtgggctgctcctgcctggtctgctgctctctcaacctatgtgccgttctgtgacttcctcaggcctgtttcttttggtcagagttatcccaccacattcctagctctcagcaatttgtgaaacaggcttaacactgatggtggggactttgcctctctcctctctttcattcttattccaaatttatattttttccatcatctcaatcacatttgggaaggggaagaagggggaaaatatgtgctcattctgccctcttgaaatgactgttaatttgttctaaatgttataggaagcttggaagcacaatcattttaaatgtgtgtgtgtgtgtttaaattctcattttattgtgggtaagtctagacatgtctatttctgatatggacagtgggaattattatttatagcttgttttactgacaacgtgtgcatttggaaggtgggaggcaggagaagtgtttttatcacaaattacactgtggttaagcttctcttatggggagaacttgcttaaacctcttggtttaccaacttgtctgtacatctcgttctctaaccagagatgttagaaatattattttcccagaggttagtcataccagccaaattgaatcctggtttaaattaaacacaagaaagatcaccatttttatattaaacccaataaagatcaccatttaaaaaaaacctggaaccagtaacaaattgctctcagttgtagcaagctgttaatgtgagtctgaggggtgcaaggtgcatacctatatccatatgggtatatttcatatatattcatatttcagcctgcctgaaagggtacagctgatcttcaaacatgagaaggtcctagtagtgttcatattcctggttctagtggttctagttgtctgtgaggttgatcttcacccacagtattctttctatactttagcttcctagccaagaacatctcctcactaaagtagtgatatgtttctgtcacatgtatccaaaagttttctaattttaactcacagccccaaccaccatctcagtctctcagaaacatgcaaactgactcagattatttatttataaagaatttcaactctgccttacgtatccactcatttaagtcctgggtatagaggaaatttcacgaaatcactgagtggtcgtagtcttatgagttacatacaggcatgggaatatatggctcttctttattttattttattttgttttttggagacagagtctcactctgtcatccaggctgaagtgcagtggggctatcttggctcactacaatctccacctcccaggttcaagcgattctactgcctcagtcccctgagtagctgagattacagccatgtgccaccatgcctggctaatttttatatttttagtagagacagggttttgccatattggccaggctagtctcaaacacctggcttcaggtgatccgcctgccttggcctcccaaagtgctgggattacaggcatgagtcactgctcccagctgtttcttctcctaaattttctttttattaaggtgataacaattttcaagttattcagaatagttgggatgtagttactaaagatggtatattggtctgttctcacgctgctaataatgacatacctgagactgggtaatttataaagagaaagaggtttaatggactcacagttccacatggctgaggaggcctcacaatcatggcggaagacaaatgaggagcaaagagacttctcacacggcagcaaggaaaagagagaagacttatgcaggggaactcctctttataaacctatcagatctcatgagacttattcactatcacgagaacagcaccagaaagacctgcccccttgaaccaattacctcccaccaggtttctcccacaacaggtgagaattgtgggagctacaattgaaggtgagatttgggtaaggatacagccgaatcatatcagatggtaattagataataattacaaaaaaaacccctattcttgcacatagttaatagactagtattttctgtgatttttctggacttttaatggagaaggtagttgcaattgtttgcacttttcttcaaaactgagctactctgttacatctcgtctaaaataatggaatcaattatctgggttgttgagcaggtgtttagcctgtattctctaaaaataaattatgtcaggctaatctaaattttttgatgaagtaactaatttatgaaaaggcataatttatcttgatttttgcaatgcttttgataaagcgtctttcaaaaagcttgtgaataagtcccaatatattggcattagcataagattgctaaaatagatgagtaactggcaaactagagaaggtaataatacacagacaataattctttagggcagagttgacaagcagggttcccaggggctcagaattcaggaatagtttaaataagatttatatcactaatttagcaataggcttacagttcagcaatctgctgctgacttctagatagtagtttgagattcagagaaacatggggaaacagccatgagtaaacaagaaggtcctcaaaacaaaatcataatctgaatttggagtttcaggctaaaggagcagctcagtggtaatgatagaactgagtcagaggcaggtggactttatgtagtgtttgattagcatttatgtctctgttgtttaatgggttgtgctctgcaactgaaaacccgaagcctggggattttttcagatgttctaatattggtttgagtactcctcatcccatgacaaatttttggacttccaaccctatcaggcatttgctagaaaattcttatctcctcttattaagccctctaataaaaaactagcattccccagtctactttgagatacacagaaataaactctttgtgcttgaaggtaagataacatatgataggaagaagtcaatatttctgacaaattaggcctcctcaaacaataccctatgtgctcttcctagtaactgatctttttggtggcttcccatatatgattctgcaaagcttcccctatcaagggatattctcagtagcagtggcagcttttctgttggcagtggctttgaagattatttttctttttattttattttattttattttattatatgttaagttctagggtacatgtgcacaacgtgcaggtttgttacatatgtatacatgtgccatgttgttgtgctgcacccagtaactcgtcatttacattaggtatatctcctaatactatctctccccgctcctcccaccccatgacaggcccccgtgtgtgatgttccccaccctgtgtccaagtgttctcattgttcaattcccacctatgagtgagaacatgcggtgtttggttttctgtccttgcgaaagtttgctgagaatgatgatttccagcttcatccatgtccctaaaaaggacatgaactcatccttttttatggctgcatagtattccatggtgtatatgtgccacattttatttatccagtctgtcattgatggacatttgggttggttccaagtctttgctattgtgaatagtgccacaataaatatacgtgtgcatgtgtctttatagtagtatgatttatattcctttgggtgtatacccagtagtaggatggctgggtcaaatggtatttctagttctagatccttgaggaattgccacactgtcttccacaatggttgaactagtttacagtcccaccaacagtgtacaagtgttcctatttctccacatcctctccagcacctgttgtttcctgattttttaatgatcgccattctaactggtgtgagatggtatctcattgtggttttgatgtgcatttctctgatggccagtgatgatgaacattttttcatgtgtctgttggctgaataaatgtcttcttttgggaagcgtctgttcatatcctttgtccactttttgatggggttgtttgattttttcttgtaaatttgtttaagttatttgtagactctggatattagccctttgtcagatgggtagattgtaaaaatgttctcccattctgtacgtttactgttcattttgatggtagtttcttttgctgtgcagaagctcttcagtttaattagatcccatttgtcaattttggcttttgttgccattgcttttagtgttttagacatgaagtccttgcgcatgcatatgtcctgaatggtattgcctaggttttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccatttcttgtttttgtcacgtttgtcaaagatcagatggttgtagatgtgtggtattatttctgcagactctgttctgttccatttatctatatctctgttttggtaccagtaccatgctgttttgattactgtagccttgtagtatagtttgaagtcaggtagcgtgatgcctccagctttgttcttttggcttaggattgtcttggcaatgcaggctcttttttggttccaggtgaactttaaagtagttttttccaattctgtgaagaaagtcattggtagcttgatggggatggcattgcatctataaattacctggcagtatggccattttcatgatattgattcttcctatccatgatcatggaatgttcttccatttgtttgtgtcttcttttatttcattgagcagtggtttgtagttgtccttgaagaggtccttcacttcccttgtaagttggattcctaggtattttattctctttgaagcaattctgaatgggagttcactcattatttgactctctgtttgtctgttatttgtgtataagaatgcttgtgatttttccacattgattttgtatcctgagactttgctgaagttgcttatcagcttaaggagattttgggctgaggtgatggggttttttacatgtacggtaatgtcatctgcaaacagggacaatttgacttcttcttttcctaattgaatacgctttatttctttcttctgcctgattgccctggcagaacttccaacactatgttgaataggagtggtgagagagggcatccctgtcttgtgccagttttcaaaaggaatgcttccggtgtttgcccattcagtgtgatattgtctgtgggtttgtcatcaatagctctttttattttgagttacgtcccgtcaatacccagtttattgagagtttttagcatgaagggctgttgaattttgttgatggccttttctgcatctattgagataatcatgtggtttttgtctttggttctgtttatatgatggattacattaattgatttgcatatgttgaaccagccatgcatcccagggatgaagaccacttgatcatggtggataagctttttgatgtgctgctggatttggtttgccagtattttattgagtatttttgcatcgatgttcatcagggatattggtctaaaattctctttttttgttgtgtctctgccaggctttggtatcaggatgatgctggcctcataaaatgaattagggagtattccttctttttctattgattggaatagtttcagaaggaatggtaccagctcctccttgtacatcttgtagaattcggctatgaatccatctggtcctggactttttttggttagtaggctattaattattgcctcaatttcagaacctgttattgctctattcagggattcaacttcttcctggtttagtcttgggagggtgtatgtgtccagaaatttatccatttcttctagattttctagtttatttgtgtagaggtgtttacagtattctctgatggtagtttgtgtttctgtgggatcggtggtgatatccccttggtcattttttgttgtgtctatttgattcttctctcttttcttctttattattcttgctagcagtctatcaattttgttgaccttttcaaaaaaccagctcctggattcattgattttttttgaagggttttttgtgtctctatctccttcagttctcctctgatcttagttatttctcctgtgatcttagttatttcttgccttctgctagcttttgagtgtgtttgctcttgcttctctagttctttttgttgtgatgttagggtgtcaattttagatctttcctgctttctcttgtgtgcatttagtgctataaatttccctccacacactgctttaaatgtgtcccagggattctggtatgttgtgtctttgttctcattggtttcaaagaacatgtttatttctgccttcattttgttatttacccagcaatcattcaggagcaagttgttcggtttccatgtagttgagtggttttgagtgagtttcttaattctgagttctagtttgcttgcactgtggtataagagacagtttgttataatttctgttgttttatatttgctgaggagtgctttacttccaactatgtggtcagttttggaagaagtgtgatgtggtgctggaaaaatttatattctgttgatttgggatggagagttctgtagatgtctattaggtctgcttggtggagagctgagttcaattcctggatatccttgttaactttctgtctcgttgatctgtctaatgttgacagtggggtgttaaagtctcccattattattgtgtgggagtctaagtctctttctaggtctctaacgacttgctttatgaatctgggtgctcctgtattgggtgcatatatatttagaatagttagctcttcttgttgaattgatccctttaccattatgtaatggccttctttgtctcttttgatctttgttggtttaaagtctgttttatcagagactaggattgcaacccctgttttttttcttttccatttgcttggtagatcttcctccatccctttattttgagcctatgtgtgtctctgcatgtgagatgggtttcctgaatacagcacactgatgggtcttgactttatccaatttagcagtctgtgtcttttaattagagcatttagcccatttacatttaatcttaatactgttatgcatgaatttgatcctgtcattatggtgttaactggttattttgcccattagttgatgcagtttcttcctagcattgatggtctttacaatttggcatatttttgcagtggctggtactggttgttccttcccatgtttagtgcttccttcaggagctcttgtaaggcaggccacgtgatgacaaaatctctcagcatttgcttgtctgtaaaggattttatttctccttcacttatgaagcttggtttggctggatatgaaattctgggttgaaaattcttttctttaagaatgttgaatatgggcccccactctcttctggcttgtagagtttctgccaagagatctgctgttagtctgatgggcttccctttgtgggtaacatgacatttctctctgggtacccttaacattttttcctttacttcaactttggtgaatctgacattatgtgtcttggagttgctcttctcgaggagtatctttgtggcattctctgtatttcctgaatttgaatgttggccttcctttctaggttggggaaattctcctgtataatatcctgcagagtgttttccaacttggttccattctccccgtcactttcaggtacaccaatcagacgtagatttggtcttttcacatagtcccatatttcttggagactttgttcatttctttttactcttttttttctctaaacttctcttctcacttcatttcattcacttgttctttaatcactgataccctttcttctactgatcaaatcggctactgaagcttgtgcctgtgtcacgtagttcttgtgccatggttttcagctccatcaggtcatttaaggtcttctctacactgcttattctagttagccattcgtctaatcttttttcagggtttttagcttctttgcaatgggttcgaacatcctcctttagctcggaggagtttgttattactgattgtctgaagccttcttctctcaacttgtcaaagtcattctccacccagctttgttccattgctggtgaggagctgcattcctttggaggagaagaggcactctgatttttagaattttcagcttttctgctctggtttgtccctatctttgtggttttatctacctttggtctttaatgatggtgacgtacagaggggttttggtgtggatgtcctttctgtttgttagttttccttctaacagtcaggaccctcagctgcaggtctgttgcagtttactggaggtccacttcagaccctgtttgccggggtatcaccagcagaggctgcagaacagcaaatattgcagaatggtaaatgttgctgcctgatcctttctctggaaacttcatctcaggggggcacctggctgtatgtgatgtcagtcagtccctactgggaggtatctcccagttaggctacttgggggtagggacccacttgaggaggcattctgtccattctcagatctcaaactgcatgctgggagaaccatcactcccttcaaagctgtcagatagggacatttaagtctgcagaagtttctgctgccttttgttcagctatgccctgcccccagaggtggagtctacagaggcaggcaggtctccttgggctgtggtctgctccacctgttttgagcttccaggccactttgtttacctactcaagtctcagcaatggcggacacccctcccccagctttgctgttgccttgctgttcgatctcagactgctgtgccagcagtgagcgaggctccccgggtgtaggaccctccaagccatgcgtgggatataatctcctggtgtgttgtttgctaagactgttggaaaagtgtagtattagggtgggagtgtcccaattttccaggcaccatctgttacggcttcccttggctaggaaagggaattccccgaccccttgcacttcctgggtgaggtgatgccctgcctgctctgtaggctgcacccactgtccggcaagccccagtgagacgaacctggtacctcagttggaaatgcagaaatcacccgtcttctgcgtcgctcacgctgggagctgtacctgtttggccatcttggaaccttgaagattatttttcagtggtgattattctgtaacaaaaacccagtcaatttttttcaatatctcattagcataatctctcattgattacatcagatctgaaaggttactcacaaccctttatggtccaagatccttcggctgttaaattgctcaacatcaatttttccattgactcatctccaaaggtaacttacagtaacatctgaaatttaccttctagattccatttcatgagatttcacagctttttgaaagaacttaagattgttcacaacgagtcttttgtactttgttactcagagtgtggcttcagaccagcagcactggtaccatttaccacttgaaagtttgctaaaatacagaatactggtttccgtggtcattgaaatagaatatggatccaacatgatttccagatgattttatttttatttttatttttatttttattttttattttttattattattttttgagatggaatctcgctctgtcacccaggctggagtgcagtgtcatgatcttggctccctgcaagcttcacctcctgggttcacgccattctcatgcctcagcctcccgagtagctgggactacaggtgcctgccaccatgcccagctacaaaagttctgggatgataggcgtgaaccaccatgcccagtcatgatttctatctaagcacactaaagtttgagaagacaggcatagcaatgatctagaaacaggcttagagagaaaacagaactttggtggcacatagttaggaattgacagagcttgtatgagttttgttacaactattttcctctacatgatattctaaggacatatgtacaatgaaactctaggatgtttcagatgactatgttctctgagtcttaaaaatgcctccccaagtggcatatctaacaacagaaggatgtgattttgcagcctaagaaatacccagtagggaaggggaaacctctagaaatcacagcagagcagtgtggaaagtcttgcagaattgtcacgatacctgagggacacacctaaggtgatacagttttgtattaacaaagatgaggttacttgtctatgtgagtgtcatgaactgcccaaccctcattgctacggtaattgaatacatgctggctgaacaaaatgttcttgttttttaatggttgttttgtttccttatggtcacagcctggagatttggaagggcaaaaatttatagaatgaaatcaaggtatttcttcatgaactttgttctgaatcaaggaaaatcatgcatctgttttacaaatcttcataagcaatactgtatttggttctaaatattgagtgtaattaaggtgttacaaattggtgaatgatgctgaaaatgactgtaaaatttattcaaaaatcagaataactatttttgtaaggaaggattcaaaaatgaatacatttatgtctataaaatgcattttaaacaggctaaagagatatgactgcacctaacaattataaaaggatagtaaataaaaactgaatataaagaggaaggaagagctattgcgaaaacctgagctgaggaaaagtaccaatttcaactgtttaattgtgtggctggagtaaagctgaggtaaacatggtcaggtccaaaatataaacacgtaaattacatatgtaactaacctgcacaatgtgcacatgtaccctaaaacttaaagtataataaaaaaaaaaaagaaaagtagaaaaacctttaaaaagtaatatgagtctctcatcctaaaaggaagaagctgaagcataaaatatgatttaaagagtttatctgagccaaactgaggagagctgctcagaagactcagcctaagtccccttggatatgagctttctttgacctttgttacagagaggtttttaaaggcaaaaaaatggggcaaagggaatgggctgatacaaagatttttgtcagggattctcactggttcatagaaataacattgattactaattggctatacattattaagctacattgtgtggttatggtttcagtgcagcattatttggttaattataccgacttgtgacaatagcctgtagtttcaaaagatgaaaacagctcaaaaagggggaggtatgcggtgattgctgtcttattttaatgactttctgggcctgataatttgaaagagctcatatttctcagataaaagttgttttctttcctcaagaccatacataaattccttaaggagctgtcaatgtgaaaattgcatcattgggtatttcaaattgtcctaaatttgctattgatccattcatagttttctttacccacctatttttgtctagaggttttctcctaaggtaactgctccaccagaattctaggatctctttttgcctacctcctgttaaaaatctttaattttcattgtgtggcataactctttttcccacttacctgtccactttgaaaaagttctctagtgtgtaaattaatgtagtaattgggttcaggacatgctaccctgatttataactgcaggagactagaatatgccacctcaaaatatgtctctgtaaccaaaatgtaggttcagtcattcaccacttacagagtccaattaacgagagcaaagtctggtatgaagaaaatgactttgattccaaagttagcttaggggaaggattatgggctcctgccttaagggtactgctttagttttggagcagaaagtaggcactttaaaaaggacactcggcatgaatggcacacagggagaaaaattcaggtgggagtctgtgtgacacacttcagtgctttatctcctgggcggtaaaggtggcaccaatgtgggcagaactatgttatacttttggttgtaaactgattatcatctcttgaggcaatctcctggtaggagagcattctgctctggagcttttaagtaagcacacagttagataagcttgccttgtagggagtgtctcgtgaagggaaggtaaaatgttataactacatgtctaaagagctaattaggaagtggggatctgagaaagagaagataaaagagaaaaaggctaaactattgcttggaaaatgggggtactcggttataattccccactgtcaggttttatgccatttctacgagatttgggtaccatatttattctggctacttcctgctgaaaggggcatagttattggatatcagtatgaaactgatctatttggagttggaaatattcataagtatgaggacttaaaaatgatatttgttggacaatgatggtatgaggtctggaaagtttctgggaaagcctgttttgcattcccatatagagggtgcaacagcagtaaaatctacagcagagaaatatgcctgttcttgcaaccagagccaaagttacaagtagcattcaccaccaggatgatcctgacccaaaccaggattctaatcattgatctagtgacaatatggggtgaagacaaagctttgatttgttggcatatgtctcacaggggtatcaagacatttcccaaattacctaggaagtatacattgcagttagtcttaattatcatgcaggttccccaatgccagttgtaactggacctcctatgaagatttgatgacaggttgattaaatatgtatttagtaggttacaggaggagctatgaatgttcatgaaggtggtcataacctctgtccagttcttgagtatgaatcaatagctgtttccaatctaggaggttgtgttacagacggggtgggcctctgtatgtgataaacataaacagatttttaataagacgtatttttatggaaatagaagaaaaacaaaggttaatgtttggcacaatttatccaaatgttggactcaaagcatcattagtgctttgagggaggcagtggtagtctgacatgtttttctcacctgtattacaagaaataaggtagtagtaatttcattgattccaaattagaaaaatggaagaaagattcaaatgcattagagacttgtagcaaagaaagaattaaagatttagtccaaattgcagaaaataataaaaatttaagtacaatgaacaagactagaatctaacaacaggtatactgtagtatttttcagaaacataggttttctttctgtagcctgtttttactaaaaacaactcatagtaggacaaatttatttgcaaaataagttttagtcttatgatgcttggcctgattattttcatgaagtgcagaaaaaaatagttgtctaccatataggatccctttaaaattggctttgctggaattcttatttatgaggaattatggattagactttttaaagcctcaagcccagccatgaatttatttatgcctaccaatacctgtatggattaagtgaattcctctcctctcaaggtcccaagataacttgtggctcctaggtttgttggaaagtgacattctttacttactacaggccatgaaccctgtatagggactgtgtagataagatatgaagccagtttttccaaggggcttttattgactctaaaagttcatcttgatcccttagagtagtctgtttgtatctgaaagcatgctattccagtcaaagcattggtaaaaaaaaatccagtgtttctaattatgtcctgttatgaaagagaacagattaaattaagtatatttacaaatagctttcaaatttttgagaaatcaggtagaaagaaagtaatatgcttaaaattttgctcacagaagtgtactttagccaactgttaaaagctgtaaataggtcaaaacagaaaaggtttctggactctgaaaaacaaaaaaattagcaatgctaattataaaatggtctgattggctttgggttgcccaccagcctcaggagaatgtccttgcagtaaaatacatggtaaaaacattatactctctggtcccatggtcttcacctcttttgagaggtgtaaatatgggatccttaatttggggaatctgtttcgcctttcagctatacctgcttattaggccctagaaactgcatgctttcctagtttttttccttaaaattctccaccagtaatttaatgccagtaatttaattaacttacatctttaagacaatctacctgtgtaagagtgtctgctttttctggccatcttaactgaaatgttattcacactatttttgcttggtttgggtaaaatatgaattctctatcttgtttcacctaagagttggccttttagtaataaaaatttagagctccctagctgacaatcaggacagagaacaggtaattaaaagactgataatcgaaaatgagaaagagaaacttaaaaactgacacatgaaaaatcttaaaactaccaaatctgcttttgtttgtatatatgtgtgtgtgtgtgtgtgtgtgtgtgtgtgtatatatgtatatatatatacatatatatatatagtgcatgaggtttatataaaagagctctaattatttggcttaaaaataacaagcatttaaatcaaacatattatcagataattagaaactttaaagcctttagctcatgtgacaccaataatctttgaaaaataaaggcagttaaagattatcagtaaagtaaaatgaaaataccatctccaaaattcagacatttggtctaaattaggcaggactgatactgtttgctagatgctttaaggtcataaactgcctttatgacttataataattatgtgacttgtctgttttacagtcattagattctaggtaagtcctagtgacatatgaagttagccaggtcccctgggtaggctgggaagagtcagatattggtctgcagttctgtctttgtcctgtgctctacaatcagatacaggttaaaattgcttacttaccaagtttttcaccaaaaataaaagttgctgagagttaaccttgtaaatgtgtaattgctgaaagataacattgtaaatgtataattataaatgtgtaacatatgaaatatgtaatttagttaacattgtaaatgtgtaattggtgtataaggaaagttgagtgtgtttttggtaaaaggttacgagaagatatgaaaatatcgtttttattaaaggcaatgcaattttgtctagttcagaggtttttaaggattgtgataagctaaaagaataataagacaaaattagcagcatgcttccaaattagcagcatgcttccagtcaaggggctgggtggagtcctgaatcccctgccccagtttcaaatggctccatatacagctgagtctgagctgagcaaagctcctatagtgccacacatacaaaaaatacaaatgcataaaatgctcaaatagagttactagaggccaagtctaaatagagcagggccccagtgacacctgaaaagaggcatagggtggtcagatgcactccaacctgtttgttcagtaccaaagcttgctggcttcttcagagttcactttatttttaccagtgaaatgctggaggtagcagacattgtgccaggaggggaaaaggaggttccccaaaacaaaagtgtttttggaagctgcttgggagttctctaatgttcattttatgggttccactagccactagcagctggtgctcagaggtgaccccatgactcacccaaagtgaaaattggctgtcaggcttggattcacccagagtggccaccaaaactgtgaccataatgcaggttcagttgctcatcacttgaagagttcaactaacaagagtgaggtctggtctaaagaaagtgatgttttatgtcaaagttagcttaggggaagaaatataggctcctgctttaagggtatctctttgcttttggagagaaagcaggtgctttaaaagaggacttggcatgaatggcatgcaggggagggaaacacaggtgggagtccctgtgacttgctttggtgccttatttaccaggtggttgagttggcaccattgcaggcagaactaagttgtacttttggttggacattgactattgtctcttgaggcaatctcctgagagagagttctgctctgaggctgtcaagtaagcacttggttagataagcttgccctgtagggagtgtctagtgaagggaaggtaaaatgttataattatatttctaaaaagctaagcagaaagtggggaacagggaaaaaggcagaaaaaacaagagtgaaaaaaatatatcttacaaaaatgggggtactcagttacatctttttggcataaggattattttgagctattttgagagactgcaatcccaggagaagtttgagaagaacaacagtagaagttaccatttggtaagggaaatttacatctataaaggaaatcaccacttgtaaatgtctctctctctctctttctgtaccaggaagaaaataagattctaaatcactggaacatcttattaatggagaaggcacagacttaaatctgcataacaaaccttacctttgtttgtcctttttctggtcatctcaacatcctttttttctttgcttcagttgaagatggtatttaggcctgaattcaaagccattactttcagatttattcattttccaattatctcccatacatatatatgatatatgtgttattaaacttgttttctttaattttgttaatctgtcttttgtttcaaaggcctgttccaactaagaactataaagggtagagagaaaattatttttcctcccctacagtttcttctctcagtctagtttcaacttttctctttccttactgttctgatcacctgctgctaggcagacctagaaaattcataaattttcttaaagcaagataagaagggtcggggtggaataataaaataaactgggcacggtggctcatgcctttaatcccagcattttggggtgccaaagtgggcagattgcctgaggtcaggagttcaagaccagtctggccaacatggtgaaaccttgtctctactaaaaatacaaaaaaataaaataaaattagccgggtgtggtggtgtgcacctgtaatcccagctactcaggaggccgaggcaggggaattgcttgaaccagggaggtgaggatgcagtgagccaagatcatgtcactgcacttctgcctgggcgaccgaatgagactccatctcaaaaaaaaaaaataaataacacttttggatcttgttgcaatggtactttaatatagttatttgtttgtacttcaggtttccttactgggctcttatttcctcaataagttgggtggaattctgatttctattttctccacagtctagcagggtatacagatcatggaaagtgattttaatattctattgaatgtatatatttggagaagaggctagcatgtgataatataaaattaaggccatgtttaatattggctgtcagtcttagcaaaagatataaaaatgctgtagactacagctttccaaccagaagcaaggctcagggaccagcagtttccatatcaccaagctcattagatgtgcaatctctgtcctaccatagactgaactagaatctaaatttcaatagagagcacatggaattggtaagcacattaaactttgaaaagcattgttctaaactgatcaaacataatttctcctttagtcaacaacataattctcaatgggcccatcatttcaccagttcatattttcttacagcacttttattactgctccttaagattctgttgtacaaaatctgctgtaacatagaacaaatgccaattggacaatgaaaaaaatgaaaatttgaggataagtgggaaaaatttgaggtacatagatagactcattaaggatgagaactatatttccaatgaatctccagtgcctagcagtgaacttgaaatctggaatgcaattggaactcagtaaacatttatttgttaactgaatgaatggagaaagtccattgactcattatggtgcttttcctaaaagaagtgtgcaattttttttaagttattgcttcccaaatattatttatctgtcataatggagcttcactaatgatggatagttgagtgtcttctttatatccattatattttgatggtttcctcaattacatttattaacatgcagcaaattgctcttgcttcttgactagaacttaatgaattatgtaggttcatatgatatttacctattcactattcaatagcagtgatcttttagacagaagtgtacttgcttctataaaccaaaaatcataaagctttagctttgtgttctaaatttggaaaaaacattctttttcaggttatctgagtttgccctgctactttcacttgagaattttgcctttgatactagaatggggtctgataattgtggacccaaaatggtaggtgaaatatgaggtagagctaggatgggagtggttagtataatacaggaggagagctagcagggactctcattgcattaattactattctgcttgtttggaggggaaattgtctacaagcaggggttggacatgcacaaatatgtgttgcaggctgatttttaacttttaactagtttagtttttgcatactcagatcacttattgaaatgtcctcatcatgtacccgtcctccgatttcttcgtttcaacacatgatttatttcttcatatgggtgttgcccaaactagcttcaagcttagaaagtgtctgatagagctattcataattccacgctaggagctgtaaaggcttaactgaagcaaataattaccagaaatgtttacattttaattgagataagttcttaataatccaaagtcaaatattcttaatgaagaaatttgaatgtagggtcagggatgagaggaaataagatttctcttagaattcaaaatgatcccagatgatggacatctggttggaagatgtaatgtgaatatgctaattaaactatgttttaaacttaattcctcagtccaaatattaaagagtaacattggttcaacggaacttacctctaaatgactgcttacttataaaacaccatctagacaaatatttcaaatattaagttttaaaatgaaaacgtaagttacgaagttttgaaagttatgggagagaaagaaaactctaaaacataatgatgctttcaacctataatgctatctttctttgtgcctttagtgtcctctctcattttcttttttacactaaaacttatacaagtgggatagtttatggtattaatattatcttctttcttcaatttgtaataatagctcaatgccattcaaacactttgactgttagcctacgaattttgtgttctcagatggtgactttttattgatctacaataagccatttataactttattaaggcaaacttggatcatgtaggaagcttcctttataaaatggtagcctcaaagtacatcaacaggcaagctaccagtgagaacgcaaaacaggaagttcatatataacatatatagcctgtgagatcacaaaacaagtttatatataacgttgcttgaatcacatagtttattaaatattaaaatttcttcaactgatgattaattttgtgtgtcaacttgagtgggccataggtgcccagattaagtgttgcttctgggtgtgtctgtgagggtgttttggaataagattggcaattgaatcaatggactaagtgaagcaaattgcccattccaatgtggttggcatcatccaatcggttgaggatcttaagagaataaaaggtctgaagaaaggagaacttcagcgtcacttcccttcattttctacttcagtattgaattgagacattttatctcatcttcttttgcccttggtctaggatttacatcatcagcatccttggttctcaggcctttcaacttggactaaattacatcactggctttcctgagtctccagtgtccagacagcaatttatgggacttctcagcatatatatacacacatatatatacacacatacatagaaccaatagaaaattatatatatacatatatacgtatatatgtgtgtgtatatatgtatatatataattttctattggttccgtttctttggagaactgtgacagaacataaacttttatactattttagtgcttttgtaacaagaatggaaatcatacaaaacgctgaaaaaataaaagcaaggaaaaagaattggataatataatacatatagaatagagtgcaagctcgtagaaagctgaatactggagtatgcaatattcacgtatctctgctccatcagccttccttgctgatggtgtggttagaagaactagtgtagacgttggagcaagtgagtccacatatgaaaaatgccttgggccaatgacccacatttgcttatcagagaaaagcagaggcatgaatgcttggcacagcttggcctgccaattagcctgctgaacagccatgagttttatttatgggtctagagtagggcacacatacaactggaatgtgtccctgttcagaataactaatgtgtgcctgttttagaagaaattgtcctcagcctagaggtcacgtgatcatagctcggtcttaccatttcttcctgtatgttaacattcttctttgttccattctatcttctacttattcatcctacctttaacatgttttataggttactaacttaccatgcacatttaacatatatgttgaattttgccagctactttgttactcattctttatatttgacatatcctatgagctttatttctatttaataagcttctagcttatttactatttttactatttcttatgaattttgtttatcccatttcctttaattccttagcagaaatacattttctttaaaaatccagcaaaggaaacaatacaatttgaatatggcatttcatcattaataaactattttttttaatctttggaggatatttatttaagaagacactgcacaaacttttctacaaaattaattatgttagtaaatagtgttaatattaacacaatgctagtgttaatggtatcagtattaacataatatcagtattaatgtgaatgaaaacaccaagagagttaggattgagagtgcaaatgctgtactggaatcccagtcattgttggatgtgtgctgaagagcaggagaaaccatgaaaatcaactcacacatgtttctcttttcactatgatagtttgttttaaaaacttttctgtgattaccaggttttgtttgttacaaaaaataccaaaactttaacaggatagttaaaggaatttcaagaaacaaccatctcgagcatgtcagttgggaaaacattttggtgtcaaatacttccttcatgctgcctgctaaaatgccttcctgaaactgtatgtctgttcacagaaacattcaccatgcaaaaattggttcacaagttttcaactcatcaagctaaagattggtgattaggtctacaacccatactcagtgtagtgtagtgcttgtgactgaagatgctggagtcaaacatcgtcacttcaaacctcagctcttcctctcactggttgagtctacttaattccttcctggctcaatttcctcaccacaatgtctttccaagtaagaatataggttacatagagcaagattcaaaagggaattatgagggctaaatcaaataatgcctatcttcatataaatgtatttaattgctgaggcttcagtaaacgacccctgctgaaaccaaggactttaagacttcatgttgacattttcttggtcagtatatattattttatatatgttagaggtagaaatgagaagataagttttttcttttccttaatcattgaaaaattcactgaacatttacattttcagaacacctcagctcctaatactttcattttcttgatttatgtagctaaatgaggaaatagaaggattttgagtctatattttctagaataatgaaagacccttttcaggtcattttaaacttttttacttcattttaattttgtactcttgatattaaagtgtccttgtgaccattcatttaaataatatttcagtcttctctaatcagtgtaattatatcctaatgttttatattacattttcctaagtatcatttttatgttgctattaaaattttattggtatactatgtcactatatttttcattttcaaccttatctaaccaggtatcataaagaaatattttaaaactatactaatatttaattttttaactgtgtaatatttttaaactctatcatttgcttacagtaaacattgctaaaagcaagttgatcaacttactgatcgcaataaaacttaatcatctttctaagtaaacagctctcatctactgttagtttatctgataaagggagatatacctaatgtaaatgacgacgagttaatgggtgcagcacaccaacatggcacatgtatacatatgtaacaaacttgcacgttgtgcatatgtaccctagaacttaaagtataataaaaaaaaaagtaaaaaaataaattaggagtcaggttaaaaaaaaaagaaaactttctccgcagtatcaggaatatttcataacatgatcttgtgtatagaatactttaaggaatatgtaaaattactgttagaactaataaacaattcagcaagtttgcaggatgcaagatcaagacacgaaagtcgatcgcatattaatgcacaaattcttatttcaatacattaggaaaaaattgaaatttgaattaaaatattccatttgtaatagcattaaaaaagaacaaaatgagctgggcatggtggctcatgcctgtaatcccagcactttggaaggtcgaggtaggcagatcacgatgtcaagaaatcgagaccatcctggccaacatggtgaaaccccatctctactaaaaatacaaaaattagctgggcacagtggcacgtgcctgcagtctcagctacttgggaggctgaggcaggggaatcacttaaacccaggaggcagaggttgcagtgagccgagatcgtgccactgcactccagcctggcgacagagcaagatctgtctcaaaaaaaaaaaaaaagaaaaaagaaaaagaaaaaaaagaagaaaatgctttggaacaaatttaacaaaaaaagtataagacttgtgtgctgaaaactgtgaaacatgtggaaaaaaattaaggaccaaaacaaatgaaaagacattcggtgttcttggaatggaagacttaagtacattaatatgacagtactcctcaaaatgacctatagattgagcacgatcccttccaagttacacctcatttttaaatttttttttgtggatattgacaagctgagtctataattctataactcatatagaagtgcaaggaatctaaaatagtcaaaacaatttaaaaagaagaacaatgttggaagctccacacttcctgatttcaaggaaaaggtaaagtaatcaaaacagtgtggtactggcataaggatagacatatatatcaatgtaatagacttgagagtcaaaaaataatcccgtatatttatggccaattgattttcaacgggggtgccaagaccattcaattgcatgagaagagtatcttcaacaaatagcactgggactaatttatatttacatgaaaaagaaggaagtcagacccttacctcataccatatgcacacaaaaaacctcaaaatcaacaaaagcctgagtgtaagagttaaaaccgtaaaattcttagaaagaaacacaggaatatatcttcatgaccttagcttaggcagtgatttcttagttatatcaaaagcaaaaacaatgaaagaagaaatagataaattggactcattcaaaattaagacatttgtgcttcaaaggaaactatcaaaaagttgaaagacaaaccacagaagagtagaaaatatttgtaagtcttataattaatgtgacttatattcggagtatggaaaggacccttaaaactcaacagtatacagatgaataagccactttaaagatgtgtgaggatttggatagatatttgttcaaaaatatacaaatgactatattaggaaattgcaaattaaacccacagtgagataacacttcatacctgttaggattgctattcagtaaaatacagatagtaacagttgttggcaaggatattgagaaattggaggcctcatgcaatgcttgtgagaatgtaaattggtgcagctacttcgaaaaacagtctggaaattcctctaatgattaaatatagggctgccacatgacccaataattccacccttagttatatccccaatagaactaaaaggataagtcaacacaagcacttgtacatgaatgttcatagccgaattattcataatagtcaaaaagtggaaacaacccaaatgtctatcaagtgatggatgagtaaagaaatgtggtatatttatacaatgagacattatccagttatgaaaatactgaagtactgtaacatgctataatattgatgaacttgaaaacattatgctaaataaaattccatttatataaaatatccagccaagaaaatccagacagaatgtaggttaggggttgccatgagctgggaggagggggaagggcatgactaataatagataagcagtttatttggggttataaaaatattctggaatttgatagtggtgatagttatacaacattctgaatataataaagcccgctgaattgtacactttaaaatagtgtaatatgaacctatcatatgatgcaaccagtcatagtacccaagagaagttaaggcacacattgatacaaagctgttttgtgcaaatgttcataagagctctaattgtgatagctaaatatcagtaacaacctaaatatctattcctttgcctgtggtcaatatccagttgcttagcctctaaagtgatggaagagattcagtagttttctggagacaagggtggaggaacaagagggaggatcacaaagcagcaagagcaaacatttggggtgattaatatgttctttatcttgataatgctgatagttttatgggtatgcacatatggtgaaacttattaaattgtatactttaaatatgtttggtgtattgtatgccaattaaactcattgcagtgtttttaaagagaaaataaagtgaaagaacaaagaaatctgagctcttagctctcaaataagaatatcacatgcttgttttgaatttaaatattctaacttgaaatcttgcttgatataaaaccttagcttgaggcccaccgagatgtgttttcattgactggcattgaaactcctccgtgtttcatccttatagctactcaagtatccattgctggatgaataattctactcagcctttcatccacctgtaatttttcactcgtggtaattggatgcaaattggctagtgttaatcatcagatgtctctaattaaaaacagaaactggaaatgttgttatgaatattggaagaaatgaataaagcagatcaggaaatacttctctatagggcctcatgacttactcctgagtgtcattaaactgtagcaggtgaaggtgccctgcttgtattgatggcagaaaagagacagaaataacctagaagtcacatatgaagtcagtgttttctaaaaattgggaaagtattcctataactcaagcacttttttaaattgaataaattaagaactttgaaaaagaaatttaattagtcaaaaattggattggtataatgaaatgcaggtcaaatggacagttaaagccttttaaaaaacttgatttctaaaataaaatgaaaacatgatggattaaaaatttaatggatattttctggaaccaaagtctcaaatttcacagcttttgggatataatagaaagtacttggtagattgaatacgatttcatgctctaggaggataattaatcataaatatctttctgatttaattaaaatttttactttttaggttgccctgtgattgctgtcattgatttgggcttctttataaaggctttttataaatagtctttaaaagaaaggaaagcagttcttttattactaatccaaataaatagctatgttattaatgtgattgattgatgatacatttatttgttatcagctaatcacttttaattaagattataatctctcaatatttgaaagttatttgacataagtacttcatttttacttgtacattgtctgcatttaatgtttctatatggaatattttgtgttaggattaatatttttaaaggtttaaagatagtggctggtttatgtatgaaccgttctataatgagcaacagcttcataagagcctttctagccagcatcctgcagcaacatcttccttcttccttgctacataggacctgctacataggagcaatatttggttcccactatgcactttggtccaagatttgtcttgggtaatatctaagtgagaatgggacattcaaagcaaaactagagtcttctcggttgctttcttcttgtctgctatgcctatcttccttatgttgcctctctttgcgccctattctcttctatctaacttcctagtgaactaacttctatctatcttcctggctctgtggatcccagactcatttcccacttctgtgaagagttgttcagggtatctcgggagctagggggctaagttcctgagttagcttccctggataccccggttctgtttcttgggaaaacctccctctccattacgttcccatggcctctgattatgctctctggaagtttcttccttgtgactttctcaccatggaaatacctggaatggacatgagaggacttcttcagtctactttctccctgagaaggtttagggtctgaggaattgttttgaagtttgaataaacacaggtttttgaaaatcacacttgagatggttttgtctgtacaatttcttcaaaaaaaacgtagtgcctttctggtctatttattttgggcacttccatatatgataacatggccaaattattgggaaaatgatttttaaaccttaggactggtctcttgattattggtcggttctcttgttatccagagactgaaacaatggacttctataggaaggcaacatacttaagaaagtgcaagcaactatcacagatgctccagtgattttgagatttccctacttgcttatttttagtccacactacttgttttgtagcttgaaatgggtgaaagcacttgagtgagaaaatgaggctgacttttaaacaaagcttacttaaatagatatgactacttaaatgtctccacaaatttgccaagagtgtttttgcagccttatgaattattgtaatgtactaaaatttaatgaaattacccattagatattaattaatatggtaagcatattcctcaactcaatatttggttaatcatctaagaatgtttttgtttttgccacttctgagttataatcatgctaggaaaataactttgggtgctaaaatgttgtattttggaaagtttggatagtctgtgagggcaatcaaagtactgtcaacacatctcagcatatgtggtatttttcctataatatattatgcaactaatactaatgttttaaaagctagtcattgttatagaaatattttttctatcctatgcaaaatagcttcccttattgtcttggtgaatcatctgcacatttgacagcaaatattactcagggcagtaggaagaatgtaaatatgatatggctgtctaataacctatgttaaacatactagaaattatgttaggggtcaaaatcactagtatgttctaagaaaataagttactgataagcagatcagagaacatgcacaacagaatcttttattgatgatatgaatgctaataaagcgaaagtgaaatgggagctaatgtcttaatttgtagactatctgtgagatgtcacactgagctgagttttattctaatgaagcattgacccttggaatgtgtctagtactgacagttgaatcattctattaacaaggaaacggaatacaggagaactgatagtcatccacttcctcataaataacttaaaaatgcctgagcagcggggagtctgctttaatttgttttcacttctatcttataaaactggtatctcatcacatttgtatattaagttagtgctgcaaattctaggccagaagggtacttactgaatgcaatgcaatgatgatatttgtgtactcattaatgctggggagcagttagagcagctagctgcagatttgtgatcaaaactgtaacaacagcagcaggagagtacccaggtcattactgaataatagttgtttctattctacaagggatcgtgaagaagacaggtccattaggacctgatttattttttcttattatttgtcaagcgtacaaatcaaataatttccatgttattgatgaaggaatttttaaccaaacaattctgtggtcttcataattatcagagatactaataacaatcccacatttttctcctgtgtgtctgaatggcctagagaatcctgatctgcttcattcatttcttccaatattcataacatcatttacagtttctgtttttaattagagacatctaatgattaacactagccaatttgcctccaattaccaccagtgaaaaattacaggtggatgaaaggctgagtagaattactcactcagcaatggatacctgagtaactataaggatgaaacattgagtagcctccagaatccaagatagtttctctttttgccaaaatgagagctttgtcttggaaaatggcaaaggatatattatttaaataaagtatcccaaatttcctaggttgttaatgatctgatttggttttcctgttttagaaatgaattttttctgttgtaattgaatgttacttgaactgtttagcctcacagtgcatcagattgttgaatttctcaggactgtctcccagttgaagaaagccaactattattagatttcaccttgtttacatttcaagaaagatcaggggtatatggctattattaatgacttttaagttttcttagagtggtttgatattttcagtactatttactttacaccatagttactagcaatgaaagtgtgtaggaaaaagaccacatgagatgctagggaacatggtataaaggaaggatttaaactattctgtagtaactctggaatgagagaatcttggattttagtatagttctgaaagcaaagaagggaagtggaaaggtttgaagtccttggaagaaaaacaaaagatatgagttaagaaacagttttctgttctagaactgatggtaggatataaggacctacagaaagccttcactgattctcaatcataatttgctctgaggttttttcctcttatatttcctctttcaattttttcttccataggaatgatgcaagatagcactagttattttacagggaagattttttgaacagcttgagtattctggtagatattgtttagatattcttagaaattcagccatgaaagttattgctctatattttacctttctctgtgttacataggagcatatatataaaagaaggattcaatactatatagaaaggttccccatattcctgtctggagctatagaatagcgcatctttaggattctctgtgcaaaccagctagttaaaaaacaaaacaaagcaaaacacaatgctcctaaatatagccacaaatttatgacccgctctgtgccagacacaatactatttgatccttacaataatactatgagggaagatattatccctatcttgaggatgaagataagatatcagaaattcagagatatgtgtcaaaactgtaactgttggatctacctctcaagcatgttctttttctatcactttgtaccacctcttacaaaattctccctcagcatagaaaaaagaacgtatctcgatcttctctatgttttctcactgatgctgtctgtatggtcactgaataatattggagtaaatgtagctctttatcaagttcaaagatttaccatcatatcatatgaagtatatgtttttgagctgcctgcaacttgagacaataattttttttcctggcacacagctacaacaccttcttcttttcttaacaacaatgggtttggctttaattgcctcttaaatacaaagtttaattatagttgcaaaactattttaagccatcaaactttctactacattatagcaaaattatcttaaaagaagaaaaaaaatttaactttagggaaactttgatagtgatagtaatatgatagcatctgaaacatatacattatatataaacatatatatattacatttaatatatggtgataactggcatttaataaaatattttaggtatatcaaaagattgaactacaggactaaaatctatgattaaaaacaaacaacagagataccctaaagattaaccagatactaaaattgacaaatactttaaaatttatatggtaaattggattgttcgtaacacaaaggataaatacttgaggtgatggatatcccacttaccctgatatgatgattatacattgtatacctgtaccaaaatatttcatatacctaataaatatatatacctaccatgtacccataaacattaaaaattaaaacaataaaatgtttatgccaagtatattcaaaaatagagaaaaatatagaaatatagaaaataggtaaaaaacttttcacaagaaaattggaaactataaaaagtagtaaacagaagttctaaataagaaaaacataataactgaaataaccatttgaaagctgtacagatgcagcagaagaggagatcagtgaattggaaaacaggtcaatagaaaaactccaaacagaatttcagagagaacaactttgaaaacagagaaaatacaaaagagatttgtgaggcacattcaaaatgttcaacatgtttgcaatggaagtcaggaagggaagagagaatatgaaagaagcaataattgaaataataatggctgataattttctaaaactgagaaaatacaacaactcacaagattcaagaagctatgtgaaccccaatcaaggtaagcagaaagagaataatacctagacagatcataataaaagcactggaaattcaggacaaaaaactcttgaaagaagcaaggactggggctgggagaggttgggtggacatcatatcttcaaaggagtaacagtaaagaaaaaagactgacaatggacctttcaataaatataataaaaactaggtggcaatggaatgatgtatttgaagtgctagaaagcatagagttgccaaagttgaatgctatacctaatgagaactttcttcaaaaatagaaggtgaaatggaggcattttcagaaaaaaaattaaagaatatgtcaccaacttacatgaattgaaataaaaattaaaaggtataaggaaaatgattccagatgcaaaaaattagaaaatgcagaaacaatgaaggacaatagaaataataaatatatagttaaatatcaatgagcagtgattgctcagaacaacaataataatatttgtgagatttaaatgtgagatttaaatgtatttgaatgtattacaaatgtaattaaatgtgttacatatgtattacaatccacaaaagatgtgattggggctaataaagttaaaatcttctaaagctgaagaaatattagcagtgtgtttaagataataatttgctgttggctgggtgtggtggttcatacctataatcccagcactttgggcaaccaaggctgtagggttgcttgaggccaggagcatcagaccatcctgggcaacttaatgagaccctgcctctacaaaatttagccaggcatggtggtgcatacctgtagttccagctacttggtggggacgctgaggtggaaggatcacttaagcctgggatttcaatgctgcagtaagctgttattgtgccactgcactccagcctgggtaacaaagtgagaccctgtctcaaaaaagataataatgtgctgtctactataataaaccaaggatgtatgttgttatatcttggataaagtaatagtaaacaaatgaataacaaataatttaagagtgctaattggattaacaaaaaatacatgacaaatccaacataagtttagaaagaaaataaaagaaatataaataggtatatcaaattgaaaacaaataacaatatagtatatgttaccagaaatatatcagtgattatataaaatgcaaatgctgtaaaatccacatgtaaaagtccaaaatttccagactgaatacaacaccaaaatcctactttatgctgcttaagagagacatgatttaaatagtaatgggatggtcaaggtaagcctccttgagaaattatatttgagcaaatactgattggattgagcaagtggatctcaggaggaagaatgtttgggcagaagtaacaaccagagccatgaccctaaggagagagtatggctggaatggataaggaacaggaaagaagccagtggagaaggagagtagagtgaaagagccaaagaccagttgcagaggcaatcagaacagtaagaagagtcagatgagaaagagcctggttggctaatgcagaattttggattctaagtaaattggagaatggttgtgggattttgagtaggcaagtgatacaatccgagttaaaatttacaagcatcattctgactgctgtggtgagaagtggaagcacgaagatgtttttggaaattattgccacaacccggtaagagttaagggtggcttgaaccaggatggtagcaatgaaggtattgagaagtgattggattttggatatagttgaatccccagtaaactggaagcagagaggtgcaactacctgtcattaactgcagatagaaaacgtgtatgaacagccaacctgatttagaagaccttcaaacagagacaagatagaacatttaagaagtgaaatttagctcatagctgactgaatggttatgttagtggacataaaaagatcagatgtggaaagtgaagtgtcggagagtcaaggataaaccagtaagacaggaagcaaaatgtccacaaatgagtaatggttgcacttctattgcatttgttgagcatccttccttttgaagctaggtttttagttgaaagtcctgctgcaagaagctaacatttcaagggtgaacacattataagtgaaatacatttaaaaaaataagaaaaataaagaatgttctcttttcccaaactaatagatttgtaaataaatattagttccctccctctctgctatacatcttagcagcatattgagtgactgtgtaaacatatttttaaaaattatatgtataatcagtatcatcaatgataaattggaaaagagcacttaaaaacacataaattactcttttttccccaggtacatctgtaaccgaagataattccttgtataatacataacaggctttctattttttggacagcaatgatttatacttattttttccttgtaaaggggagtatccgattcttggggacatcaattagtgaatctgatgaggaggattcaatgatactataaagattaatggtcctgtgatttctgagacaagatgtattttaaagtcttattgagtgaattgctctcagcatcttgtcaagtgatgcaaatatctactgtagggtattctgcactggcaaaggactaggattatgctttttcattagtagatgatcatatactctcagggtaccctaagtagtttgctttataaaaattaatgctcaattataaaatattgacttttgcaaattttagaatcatattttattttaggaatctcagataaaaccatgaaggaatgacagggctagccagtcttcttcatcttgatatccaggaggcttgtacattgacaggcttattagttgatgctaatatctcttcattgaattcaaaatacagagtacttgtcaccttgttaaaatgcagaaagctttttctttcttcttgcatttgtttacggaatattatgaaatatgagtttagaaacaaaagcacttccagatagaaagctcctggtcctttccagtataaccatgaagatggatattttataaaactagtaagtttggagcaatagttgtaaaactcctcatgttattgagattaaagagaaattcacagagatcaaaactttgcataaaacatttggaaaataaattaagtaaaaataataggcaatttataaataatgagaattttgagagaagaaagtaaaactctttttgtatagtaagactctgatatttaatgaagcaaatcatactgttctaaaaatgagaggatttttacttgcctaactccttcctaacaattatgatttttaaaatagtttaaaggcagtttctttctttataaaacaaatctaaaataaagaaacttataaaaattgcttttgttaattaatatcaagtacatcatgctgagaaaacttgttctaaaatcataggtcatgaaaaactttggtgtttgaaataagatttgggagaatgcaacatatcattcttgtctgaaggatctgagccatgcgggtcactttgacataaaaaagcagcatcaattttcaatccagctaagcttcagataaaggtttttggacacaatattccacataaatcgtagctttgcctttttcaaaggtaataagaccctgagtactcttctagcctgggtgatagattatgatgttcttaatatggtctaaaaagaaaaatcctcagagcccatggcccaagtcatgtaaacaatgttttccacattgttgaattgacttacaattcggattaccattttcttatcaacgatttctcaagttccactttattctttctgtctcctgaaaaaaattgctgatgtacccagtttttaaatgatggccacatcctgagctggtcccctatttcccctagtcactccttatgcttcagcaccatccatccccttcagcctccaaactccctatttcagaaacattccagggttccttttgtgcccactctcccttgctgcagcaagttaataaaccataaacatggcttggtttgactataatgtgttcctggcatttcttttcttacgctgttttatgacaactttcactgtcgcatcaaactgaaagacagcaaaaatcatattcttctctgagaaataaactcaagaacagcaatccttttaactttagatatttatataaaaatatcattgcaatccttgaaaaaaaaagctagatagttctgatgggtcattaattcatcagattaattggtattgtaattttcaaggtaatatttagaacacacacttatagaacatctagggtacatttttttagaagcaatggagagtgtagaataggccagaaatgtggatatgggttaataattagattttcagagaagagaaaataggcttgttctcagaaggaaatctggggaagttgatgttgattatcatgtgtgtgtgaagatcatgagtcgatagatttctgaacatctacaagaaaagctaagcaggttctcaaaagactacactagagagtaggataaatgaataaaccagtaagttggttactagaagtccacagagcagaacaaggggacagactcaatcctgttgtagaagtgtttgtattagtgcagcatgccagggttttgctagggctcctggctcctctctcatgaccagcagccacgtggagaagggatgaggctgatctccaggcacggcacggaaggaggagatctcttcagtggtggacatcctctgcttacgttctgtgggtgatagagctgatcttgagactcgtgtcttcagatattaatgaaaataaacaagaaaaattcctaaccgtataaaagacttaaaatcttgatacataataaaggcaaaattattcaagtcacagacattcacctttattggatacaagatgaacaagtaaggaagacaagatacaacttttagtagacgatagttttttgggggatatttatttctcaacataaatgtgccccaatttcttgctacattttacttgagtgttttcatgcatgtgtgtacttcaacgagttcttttataaagggaaatttagagcccagagctagcttctctgatgaccctatgcagtattgagtataagaattaaatgggaagaaacaaaaaatttagactgaagtaaacatttaaagtgcctttttgagtcttttgaccttggtttttataatttagccaagagtgtgcttgcatgagtcaaactaactcccatcagtcccctgtctttctgtaactaaagttcttttcatctttattttctttgcagtcattcattttcttctcttccatagttttctttttaagtaatatttggtattttaagattaaattcccagacacctttcctccaggcggaaaacactgtgaaagggaatgcaaattatttccaataaaaatggtgtaagtgtgaaaacttacagagaatgacattttctacctttcatcagggggagttttaactacatttgatattaaggtgttaaaaaacacatttccccagattctgtgacttatcaaaccaaatggccttgttctggcctagtagtaggcagcttgcagtccccacagaaaaacttggttgagagcaggaaatgcaaacaagtgaacaaacaaaacaaaccaaagccaagaacagccatgctcatttattcagcaaatattcttttatatacttactgtgtgacagacactttcctacattctggagattaaaagaaaaaaaagctcagccctggcccatggactcagtttacagacattgggaggatagatattataaacatgttttttttttctatgctattgtaggcacacatggttgtatcacagtgagtttttatctgagtagaaatgtgggtcaaggctgctttctgaggtaaattacatttaggatgagaggatctagagatgaagcaaacaccttttgagtccttagtaaatgaccaacattgtgctaagtactttagagatatcatataattgaattatatcaaaatctaaagtgggaaacagcacaatcatccccttttttcagtgagaaaattgagccttgcagaaattaagtgacttacccaagatcacagagcccattcagggccaacttgggtttgagttcatgtcgatttcggtgaggtgcccaaagccaccttcttttaccttctcacacattgtaggcagtatgctgaataagtcttaaaaaatacagttaattttttttccttcatggcagttctggtggatatgttgatataaatatcctcttatctataaaactctgaggcttatgttcacaatgtgaatttaatatttaatttaatatttaaaaaggcaaaatgtgaatctttgatacagcaggataaatgcctctcccaagttactctttatcttaacatgtctcaatacgcatagattaaaaagtactttaaactgaaaattaaagttctgagtctgtcccactctatacatggacaatggggatattctgattgtcccaaattaattcctgcaatgatatccacccaccatcaaagcatctggcactttagtcagcaacaacattaaagattaatgttataagaaagaataaggccatttacggataatcacatatgcaaaccaactagctttattgactaggcaactatcattcaaatgagtctttttgatattttcagcctggcgtcttatgtcttgtgcagacttcacacagtcttccagtacattggattatctgttctgacttacacaatttatttactttgattttgttatcttgcttcaggtttcactcctttttattgctttaactattagtataccatgaaagttctacttgaggcatttggcaagaatgtctgtacttgaagacagcctatcatttaggatgctttcgactttaggaaacaagcaaacaaacaaaatcaactccaaatggcacagataacaagtaacataatctacaaacagaaagttttaaagtagaatagatgaaggcatcattaattcattggctaaataatattattaaggatatgggttccccagcccacttctgtgctatcttctgtgtcttcactagctttccaatggtgccaagttgtgtgtagactttctaggctccataggcagaataacagtgctccacagaagaagaagccatctctttctgtgtgcctctttttttttttgacaaagaaaatatgttgtagaagcttcctggtagactttctttcagactttcgttggccagaagaaggtcacacatgtcaactccaggcttacttgctctcagattgattccttaattctccctgactcaactctacattccaggaggcctcagtttctgaaggctgtttctctgactcctggaacaactggtttctgggtgaatttggtcacagggtggcactgctgggagattaaaggataggtaagagagagaagccagggtatttcttcttcttcctctccctcggctgctacacctccagcagcttctgtcttttctgttttctaacatctgccaagctagtggacagtgggtccagattctgcagataatccggggttatggtctaaatgtgtgtgcttctcacaaatgtatgtgttgaaatcctaactcccaaagtgacggtttagaaggtggagccttggggaagtgatcaggtcatggtgggtggaagccttcatgatgggattagtgtctttataaaggaggcctggagcgaccccttcaccctttctgtcatgtgaggatggaatgaaaagatggccatcgatgcagtgggccctcaccagatatccaacctatcagggccttgatctttgacttctcagcttccagaactgtaaacaacaaatttctattgtctgtaagttccccagtctatggtatgttgttataacagcactagtggatcaagacaccaggccagtgggctttggttcgacttcctgttcgctttgcctttccagcttatgaatggttgtggcttggtatccttcctcaactattttattgctgtgtaaaaaaattccttgcattgagttctccttgcttcaaacacttgtagtgattatgttttcctgatgaaatcccaaatgaggtgtatgcccaccagtaaaccagttactagcaaggagaatggggtctccagattttgtttctgttgcaaggttgaaggtaggcagtttgtgttatacagataatggagtcagtcttctatttttctctttaagattctttgtatgtaacggaggaaaagaataccttacatatgcctggcagcagattggtgtaaagatacacgaggggtaattattgcaaagtaagaggtgatttaaaaaggaattaaaaagtatatatttggcctctgtattattttttcttgggctgctgtaatacaacaccacagaccaggtggtttaaaacacagaaatttatgttctaacagtttgggaggatgacagtccaagatcaaggttctaactaacctggttccagtgagggctctgttcctggcttgcatctggctgctgtctccctacatcctcacatgacctttcctcagtgtgtgtgtggagaatgagaaggagagtggaagtcagcactctggtgtctcttcttataaagacactaatcttactggattgtggccccacctttatgaattcattaaccttcattaccctgttttaggccttatttcaaaatacaatcacattgggatttaaggtctctacatgttatttttgttgggggaatactattctgtctatagcattcccagttggttttgccatatatgatgatacctggtaattttctttaatcacattgcatgccagctttctgttctctgaagtagggttgttgacacatcggcattgggatgaaaggggctgtgtaagtgaagaattgtgtaccattaggctttactgatatggctgattagatcttatatacctcgactctaggaaaaaggcattttcttttattttgtctggttctgtgttttgaaggatgtgttacctatgtgaacatgcctcccatcttgcttttgttgtcttcattgtatttgttgctttgcaaagacatagtgagggtgagtttaagatttaaaatacaggtgattaaataatacttaatctctgggataaggttaggggaggagggacactactttttcctttgtgactaaatcaaaacatgaatttgatgtaaaacccaaaactataaaaactctgaacatagacatggacaaagatttcatgatgaagacattaaaagcaattgccacaaaagcaaacattgacaaatgggatctaattaaactaaagggtttctgcacaagaaaagaaactattaacagaataaacagacaacctacagaacggggggggaaattttacaaactatgcatcctacaaaggtctactatccagcatctataaggaacttaaatttacaagaaaaaaacaaacaactccactaaaaagtgggcaaaggacataaaaggacacttttcaagagaagacatacatgtggccaacaataatttgaacaaaagttcatcacttctcattagagaaatgcagatcaaaaccacagtgagatactatctcacatcagtcagatactatctcatatcagtcagaatcgctattactaaaaagtaaaaaaaaaaaaaatagatgctggcaatgttgctgagaaaaaggaatgcttatacactgttggtgagagtgtaaattagttcaaccgttgtggaagacagtgtggcagttcctcaaagaactaaagacagaaataccatttgacccagcaatcccatcactgggtatatacccaaaggaatataaatccttctgttataaagacacatgaatgcaaatgttcattgcagcactactcacagtagcaaagacatggaatcaaccaaaatgctcatcaatgatagattggataaagaaaatgtggtacatgtacaccatggaatactatatagccataaaaaataacaagatattgttctttccagggacatggacagagctggaggccattatcattagcaaactaatgcaggaacagaaaacaaaacactacatattctcacttataactcacttatggtgaaaacacatgaacacagactggggtctgctggggggtagagggtgggaggagggagaggagcaggaaaaataactaatgggtactagacttaatacctgggtgactaagtactctgtacaacaaaccccaacaaaagttgacctatgtaacaaacctacacatatatccctcaacttaaaataaaagttaaaaaaaagaactgtaaaaaaggtggatttgagagatttaaaaatcaaattaattagtaagaataattaacccctttttcccacatgtgaataatattctaattccttagtccatgctccagaccaaaagtatcagatggaaaagagaggtatataaatactgtctatttttattttttgatgtaagttaacgtttattaataaaacaactagagatatgaacatacagactcaataagaagtaaaagcaagatgcagaaataaaagttaaatgttcagaaagcagcagaatttgattgagggaccagcatatgcgggggcagttggaaattagagtgtgttcgttagaaggtgttgctgagaattttccaggaagacagaaagagattttaaaagatggaaaatcttcaagtttcagaagatacgaagaaaaaattatgctcagcttcatgttccagggataatgtgtgtgaagatgtgtgtgccggaacaagatacatttaagaaagttcctgaggggaggtgtagtgaaagagccctatcaggggattaaaggcacatgcgttgctgtgatctagaaacaagactttgtatctggaactaagccaaagaatgagaattgtctctaaggagaaagctaagggattatgaatggagttcacgaatggaacacaagaaactataaaaacacacaacattgataagagcaaatgtaactaagttaatagtgtttgtatttaattataatatcttttactaaaataacatattttttgctagagttttgacctagaatatacagcagagggggactcttgactttcctatcctctaaaagacaacaaaaactctggggtagatatagtcttttttttaaagatgagaaaattaccaggtaatttataggactcactcaaaatcacatgatgtgaactatgtaagactagaattgaattctgcattttgggggcctcccctcttccttttcctagtggcaaaggaacatcacaagcagtacattgagcccctgcagttagacgcaaacaatgctgatgcatacataccacacattgctgttgtttcagcccactgataatgggacaattcctttctttgccaataaaataaaaatgcggaaaagagaaatccctttcagtggtttactgtatatagaaacatctctatgtagaaaatgtctcaatgtagaaagactgggacagcgtaaacatttttattttgtagtaggttcatatttctcaatccataaatcttcaatatagaaacaaaacctaatttctttgttttttatgtcatcacaaactctcatttagtcagacgccagaaaacttagggaagccatgaggaagaggggctctcctttagtcttctcacaggctctagcaggtattctatcccatttggtccttgggcatggacattctccacgggctttaactggggcttctgtctttccctctgtactgtggcctcttggaccatgctacttttcccagtggcagggccattagacacactctgaattctctatcctttctctttctctctttccctaatctttcttgatggacagggatggtttggctgccacgacatacttctctgggctgtgagaacacttgatgtggcaaccacgggttctctctttgtcagttagcatttatttcctactgtcccctccaagctctgatgatgtgggacattttcaagtatttcagtgaaatcagcaccaactaccttctacttttgtttttcaaatgtaactgggggccttttcttactgccaaccatagaattagtcttgagcagtgaagactcaagacttcaccaggatgtatggtgctttcaggggatttttatctagtctgaagcacagggaagttggtacagggcaagataattatgtctattcatttcttaaaattccagaatttgatgcttttgttctcaggatgcagaatagcttctccctttaggacaagaccagtatcatatatagcacccaaatataggagaatcacagagataaaaagagtttaatctcactgcaattatttttatttcattttaaacaaaaactttactttttctctatatttcacaacacagagctcttctgagctacacatttttgggtaaatttgtataacatagggcaatgagtggctgacctttatttcatatctttgggaatttttttccccaatgttgtcaatgaccacctgcaataaaaaatcatctgggatagttgtttaaaattaaaatgcaggcctaacccagatttattaaataatgccctctggggctgagcctaggtatccacatgttaacagttacacctgaggtattcttatgctaatcaattttgagaaactctgatgcaggattagattaggttgaattatttcacttgctaggacagttcaaacaggaatatgtataattggagacgtttctttaacaaaataagaaaagatatctaatatgtaatcatctgattagaatgtcttaattgtgtgtcctacatattcctaaagaaaactgtattactcctaatggtgatttaatttaaatggagagtcccctagacttatatcacttgaatcatgcttaaggggatgaaattttgatttgtgatagtaactacacaacaaagttgagcatattttggaaaaattgttgctcatctacgcttgtggaaggaccatttaaaatgcacacatacatgcatgtgcacacccataaatatacacacaccccacatacgcacaccccacaccacatgcacaacctaaaatactcatctactttctgtcaagaagaagattagtatgagggtcaaaacctttattttgtgccttgattttatgactccaaagtgaaatatactttattactttcctagggctgccatgacgaatgaccacaaagtcggcgacttaaaatacagaaatttactatctcagggctctggaggccagagatccaatcatggtgctcacaaggctgcactctgaaaactttaggagagccatggtccttgtctcttctagtttctggtggctccaggcatgacgtggcttgtggctacatgatgctcatctctgctcccatctaacatctccttctccggttccttttctgtctgtgtctcctcctttgctgtctcttataaggacattcatcattagacttaaggctcacacagataatccagggtatccaccatgatcaagtgggcttcatccctgggatgcaaggctggttcaatatacgcaaatcaataaatgtaatccagcatataaacagaaccaaagacaaaaaccacatgatcatctcaatagatgcagaaaaggcctttgacacaattcaacaacccttcatgctaaaaactctcaataaattaggtattgatgggacgtatctgaaaataataagagctatacatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattggatatctagaaaaccccatcatctcagcctaaaatctccttaagctgataagcaacttcagcaaagtctcaggatacaaaatcaatgtacaaaaatcacaagcattcttatacaccaataacagacaaacagagagccaaatcaggagtgaactcccattcacaattgcttcaaagagaataaaatacctaggaatccaacttacaagggatgtgaaggacttcttcaaggagaactacaaaccactgctcaatgaaatgaaagaggatacaaacaaatggaagaacattccatgctcatgggtaggaagaatcaatattgtgaaaatggccatactgcccaaggtaatttatagattcaatgccatccttatcaagctaccaatgactttcttcacagaattggaaaaaactactttaaagttcacatggaaccataaaagagcactcattgccaagtcaatcctaagccaaaagaacaaagccggaggcatcacgctacctgacttcaaactatattacaaggctacagtaaccaaaacagcatggtactggtatcaaaacagagatatagatcaatggaacagaacagagccctcagaaataacgccacatatctacaactatctgatctttgacaaacctgagaaaaacaagcaatggggaaaggattccctatttaataaatggtgctgggaaacctggctagccatatgtagaaagctgaaactggatcccttccttacaccttatacaaaaattaattcaagatggactaaaaacttaaacgttagacctaaaaccataaaaaccctagaagaaaacctaggcattatcattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaataggcaacctacaaaatgggagaaaattttcacaacctactcatctgacaaagggctaatatccagaatctacaatgaactcaaacaaatttacaagaaaaaaacaaacaaccccatcaaaaagtgggcaaaggacacgaacagacacttctcaaaagaagacatttatacagccaaaaaacacatgaaaaaatgctcaccattactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatataccgaaaggattataaatcatgctgctataaagacacatgcacacgtatgtttattgcggcactattcacaatagcaaagacttggaaccaagccaaatgtccaacaatgatagactggattaagaaaatgtggcacatatacaccatggaatactatgcagccataaaaaatgatgagttcatgtcctttgtagggacatggatgaatttggaaatcatcattctcagtaaactatcgcaagaacaaaaaaccaaacaccgcatgttctcattcataggtgggaattgaacaatgagaacacatggacacaggaaggggaacatcacactctggggactgttgtggggttgggggaggggggagggatagccttcggagatatacctaatgctaaatgaggagttaatgggtgcagcacaccagcatggcacatgtatacatatgtaactaacctgcacattgtgcacatgtaccctaaaacttaaagtataataataaaataagaaaaaaaaagataatccagggttagcttattttgagacccttaatttatatgtctgaaaagacaatctttccaaataagttctgatgcacgggagcctggggttaggatgtgaacatgtcttttaggagcagccaccattgaacccactacaaacattgtggccatacttcaatttttatatttgtaaatttcttcagaatggtggtggataccacttttatgcctcctctcctggcttgaggcagaatgcctaatgaggaactaatggcccaaaaaagagagcaagtggcagaagaaggaggaattagataatcctgtctacaaccataagggctgcctttcatctttttcctaaacctctttcaaaacttggcatctggggaatgaaaatctatttctttaacttagaatgtggagtaaacttagcttgagcctaggggaataaattttgttcagtttgtggaaatccgccttatgattttaaatgaattttttgccttcttgcttaatgaaggcatcatgagtgaataaccattcatatgccagcctgtaggagccattgcaatgttgcatctgtagactgcctgtcacatcattaactttaatcttttcttagtatttaaaggagaaagatgaaagggaaagaaaaactaattagtttaaaagatagatggtacattcttttgagtagaatttaatttaaaataaaagtgtgaaatagcttttatgaaaaaggccagcacaggaggaaaagaaaaagaaatgtggaagaaacgtagatgaagatcttgaatgctggctggtggtattggacatattttccatacttgagcatcagttgttagtatgggctaaagattgattaaaatggtttaataacacacacattctaaaaaatctgccagaaacatattgttcaccctaagagtgtaatgacaagaattttaggtcttaaactcttaaatgatttctaaagggtcgtgttgattattatgtcatagggtccacagtgaatatgtgtggaaaaaacagactgagcaatctagaaagctaaatctataagatcatgaggcatggcaaaggacttaacttgccttgctttcaagaaaaaacacaccacaacagagaggaagtaaatcatgcattttttcactctctctaggtttgaatattcttactttaatagcttttgaactctaaaatttgagctttgatgtctaacattagtgaccatggttaaaaaattcattgaaagctgccttattagtctggccagagaaatgtaaaattgcatacaacaggttagatattgagaaagacatatctgggatgttttgatatcatttttaaggggtgtagtcaaacctcaatttagaaaagttttggtctttacataaaaacatgatgctagaacagtttttaaagagcttcaatatcaaagaaaaggaaatctgtacatgagctttatactttagaacaacaccttagaagaattatcttgtgaaatatggtattactttttaggtgcaatattgagatatttttaatctctaagtattaattacaaatctctaaaatagctcctgtatctccaaaatgcttccattagaatgaagtggcattgttagaattagcacaacctacaacttggcccaaattttctttgtgtagttgttttctatagaaagatggaaccaaaagcatcctacctcattagtttgcatacaattctgaattctaccctgtaattcgtatgaaaagattatgaaattgaattgagtgacctaagaggacagtatcaactttatatcatttattatctttgtagtttctgactgaacaaaagtgccatttataattatctccttctaattgttatagttcaaaaaccaaaaatggaaaatctatatatgacaaatgaaaactatcctataggcatgagtgtatctaataatttatgtgttcatttttcaatcatctttgctgcctctttacaaaaaaaattcatacctccataatgaatatttcatcttgaatatttatcatggaatgtgttcttttaagtttttaacattacactttttattggagctcttaaatgtagacgtagtgtatcaagtactccagcaaagcaatgtattgttttctgtccttaattttcatacattattacctgaaagactgaattatttcattagttttgaataatttgaaaaaaatagttcatagacttctaaaatttaaactttttaatttttcataaatagttttctccaggcaagcatgtctgatcagaaaccttaatctgtaggaaacctgaggaatgtttcttcctcaagagaagcatcatatcttttggtcatcaaaatataacagttttgcaaagaaatttatgtaggggcaacagaaagagagcaaaaccccattttgataagcgtatagtatgaaaactatcatcaatattctaaatacctcagatttgatgataatattggttagatattttgaaattggtttattagttgagatagtattgaacaactctctcaagatattctttcctgttttcagatctctttagctcatgtgttttaaatgattctttttctttttaactcatggttaaagtgacaacatctgcaaaaagaaaaagagaaaattagaatatggaaaaaaagccataagttcaaggcaaaaagatggagatggttcattgaagaaaaatgaatactgtgaagttccttatttctttcttcatctcctgtgctttgtttttgcaaaccaatgccagtaattccaaatcaacaaatcgaggtatggttccttacggatgcaaactgtcatatttcacttatcattcttagatttcactttgtccccaaactctttcagagtaagaggctgggcatagtggcttatacactttagtaggctgaagtgggaggatcacttgaggccaggagtttgagacaacccttagcaacataacaagaccccatctctactaaaaatttaaacattacccgggcatggtggcttatgcttgtggttccagcaactcaggaggctgagacaggagagtcgcttgagctcaggaagtcaaggctgcagggaaccctgactgtgccaccacacttcagcctaggtgacagaacaagacctggtctctaaaaataaataaataaactataaaagctataatagattgggaagggttggtatttttgttggtatttataaacaatgtattctatattcttatgcatctggtcacagattggattgtctggtatagaagctatttgggtttttattcaccagtagactccattgaaacaataaaaacgtccattgtttcttaactacagttattttatttacctgtctaagatcattagtacaacgtacagacaggctattttacctaaatcccaatctccacaaattatcttgtgaatgatatctcactattattagtactcaaagtctcagacttaaacactatttcttaccttatctaagagtcaacttgcactggtgataagtttagaaatacaattactttatccaggagattgcctacaattaaaatgtcccaaagcatctctgacagtgacccatagaacctggtgccaaagtgattatgcacagtactgaaataagctaatgaccctggctgtggctatgaaactctctgtagaagaaattagcccaacatgttatgtagatatattaagacaaggagagcaacagaggcttaaaactttgatccttctgggcagattgaaatttttggctgatgcgtttaaccaaatgatttgggaaagagaaggagatgacaagtcgttaaggcagtacaatcacacgtcttaaatgttggcttcgtggagcatctaattctcatttcattaacataccaagtaagttccagagacactaaaactccaaatacgttacatgtaagtatgtgtaccgcagagtcataaatgggagattttatctgaaggactgagatttaattgatatcatcgactaaggagagctatggtctttcattgtaatcatgaaaagctagttatattatccttaagtcccttacccatgtaagaaagatgggttgagtcgattgtagaaattagttctggaagggattttagagagtgcaatgttatatctcttatacaggggaggagaatggaggtatctaccctttcttcaagcataagagaaagaagcttcaatagtatcatttttaaagtttgatgtgtattacttgaagctgaagcaaacacaacaaacttgtgtttcattcctgcctgagaaccatggagcataagagaaaaagccagttagcttcctcttgtaatgagtgtgaaatgaaagttcctgctttgggaccattgtgtatttccagattggtcagaacaaaggatgcagtggtgtttctcatgcatgagatataggccacatatgtggtacattatagggctcaaaataagttatctttaacagagccagtaagatggcccacaaaaccacagcaggtaaaaaatggaagtacgattaaatctcttggatctaaagtaccattagttctcatacagaatttaggtgaacctactggatgttcttgccctacttagggaaacaacaacaatacaacaacaacaacaaaaaaaacaaacaaaacactcccagtaactgggcagagcttcaaagaatttatgaaaatattcacaagagatctgccagccccaaaagcattaagctgtgttataacaatgatgcagggtgttttcttgaccccttcacgggactcgtgaccagggtgcctcatttactcagactgccccactcaaccccttgcaggagggagcatactagcaaatgagtgcaggtgctggctgccctggtgctggcaggagtgaattctgtgcgtgtccctcagcaccgtccagttgggggtacctgccacccccaaggccccggagggcatgttacaatgctgtcttatttctgccgtctgcagacagcagtgtgttatcagctcagtgggcacttcacctcattgtgtggggcagctgccctctgccagtgagggcaaagggtcagtttgacactctttttgggcacccacagctggtgcagcccaaattcttgtctggtgcccaagaggaatgaggtcacacaaaagaattgaaggatggtgaatatggataattttactgaatgatgaaagtggctctcagcagagaggggagctggaaaggggatgggaagggcaggttactgtcccttgaagtcaagccacctctctgccttgtccagccatgtctctgaagacaagcttcccctctccaacatctaggtgcttcttcccgacatccagccacttcttctctcttacggctgagtctggggtctttataagcacaggatatgggttgaggtgggccataggtagctctggaaaaggcaacatttgattggtaaaaagacattattcagaaagaaccaatctggagagagcgggcacataggaatggaagttctcactttgggccatggtttcaggctttttggctcgaaggtggggttttgccagggacctgcccctgtctgcctagaatttctctgcctcttgtcactatcaacaactccacttgactagaagctttcttgctccccatcttctatttctctgctccaacactgaagggttcaaaaagaatagatggcaagtgtgagaaagtgaaaaagaaagagccaactacatccctctttcaacatagtaagcattctggtaaacacatgctttctcaggagaagagaagcaattatacctgatttaggttgaaagctttattacctgagactacatgctaatttctgagtctgtgtttagtgattttgaaaagaatactgagctaagagttatccaaaatgtctaagaacaactgcccatgttttcatctagtgacagggaaagttctctacctaatgaacacatttgaagtaagcgctgggcaaagaattaagctattttcttattacatctcataaaatacatgaggtttttttttctcttttaactttttttatttgggcataattttatagagagttgaaagaataagacaaataaattccatatattcttcatccagattcccaaatggtaacagtttactaccttagctttaccaaatagcctcccccaacccctgaaaactacacacatgcacacacacacacacacacagacacgcagaaataatactgttttattcttctatgtgcattttctaaaatgaggacattgtttcatagaacctcaatacacctacaaaataaggaaattaacattgaaaacggagtattttctaacctatagagcttatttagattttgccaattgttccagtaacgcctttcacagaagaagaaaatcccagatcatatgttgcatttagtggtgtcatccttttaacccctttttgtatgaaaaaattgcttagactttctttgtatttaatgatgtttgtatctttcaagaaaataggcaggatgttttgtagaattcactcaatttttattttcctgatattatgttacaattaaatttggattataaacttagaacaaaaataccacccaggaaatgttgtgttcttcccagtgcatacgatcagggaatacaagatgtcttgccctatttttggtggcaactttgtcatatggttaaggtggttttcaaatttcttcattatcattttacatttttccctttatagttaataacgttttctggagagataatttgaaaccgtaaaaatatcttaactactccctgaatttttgctcactaactttagcatccactgaggattcttttctgaatcaattttattataattttttattttcttattccttgtatgtttatcaggtggctgtatactataaagaatcactttctcctatcattaattaattaattaattaattagtatgtctagactgacagattcttattttattcatggaattgcccatatttggttactaggagcctcaagtccagatgactcttgatttcttttgatacttttatgctgtaataagatgtttgagatttatcttatactttccttaattcagccctggaattaggcctttctccaatgatatttagtggagaatgctatttagaaaccaggataggctactagagtgtcattgcttctaggccttctcagccttcaaaaataggatatgtttatgtacatccatgcacatttatacatatttctggatctactcatctgtatttaaaagacatgaatttatactgatactgtttatttcacatcaacaccacacagtttccttctctatatccatatttgcaacttctccaatactgagaaactacctcccattatgcagtatatatttacttaattttccaaaactgaaatacacaaaacatagaagaatggagtgttaattttcaaattgccttcatagaagaatggactagtaatttgaaaatccactagtcattcttttatgaaaaattagccttctaacttgagtttaaaatttctttagaattatattgctttcctatcttgaggatacatagcttaaatactatgttcaaaagatgtcagaaatacttctctctcttcccctgtgtactgctctttagcgtggtcagattaggaatttgaaatacagttccagtttatttttattttagaatctccccctttaaattgtactcattgtctttgaagcatctggagcatttacatgattttgaaagtaataactgtacaaaaagctgtagttggagatatgttaatccccacagattccatctatactctaccctatccccatctactctggaaggtaatcaatgtcactagtttctgatttgttctcttttgtgtccaaatgagcagatacataaattttctgatttttctacttttctttttcttttttctttttttttttgagacagggttttgctctgtcacccaggctgatatgcagtggcacaatcacagctcattgcagcctcaacttcccagggtcaagtgatcctcccacctcagcctcctgtatagctgggactataggcgtgtgacaccatgcccaactaatttttgtatttttggtggagacagtgtttctccatgttgcccaggctggtctcgaactcctgtgcctaggtgatctatctgcctcagcctctcaaagtgctgggatttcaggtacgagtcactttggcctgatttttgtattttgcttacacgaaaaatgacatatgataggatcaaaggctagtgattaatatatcaactttactgacattaaagctgagttgaataatagctcagattaagcttgtgatatagcttggatctgtgtccccacccaaatttcatgttgaaatgtaatccctaatgttggaggtaggacccagcgggaggtgactggatcgtggggctgatcctttaagaatagtttagcactgtccctttggtgctgttcttgtgatactgagtgagttctggggagatctgatggtttaaaagtgtgtagcacctctcggctctctatcttgctcctggctcctaccatgtaagacgactgctccttctttgccttccaccatgattggaaactcactgaggcccccccaaagcagaagtcactatgcttcctgtacagcctgtggaactctgagctaactaaacttctttttaaataaattacccagtctcaggtatttcttcatagcaatgcgagaattgcctaatacagtttgtgactataattatgtttcttagcgccgtctcagttcagaatttggaacaacccacctgagtgagtgttagagaccaaagagagaaaaaaccccacgcagaatcattgtcttgcacatactgaaggtaaagttaatatgtatccttaaatttgtttgaattgtgaaatattttattcttaaatatttaaagcttccaaaaaaatgtgagaaagatgaattttaaaatacttggaaaatatctttatttgtagacatttacttgatatgcaagtttttgaagcactgaaacagaaatatcctgtgtatgtactttaacaactaatctgttgcctatgtaaatagtgtgctttcaatattgctgattgaatttaggattagatacatggttatagaattaaaaacaaattgatacataaatttatagagaaaagtagaaattaagtaaaaattgtctgccattaaaaatactgtcactggcctacaatattcactagactctatctgtattttaggacatacattaaatcaatatgtattttttattcctgacccaacctttgtttagccaagcaaatgtgcaaggaaaaagttacaagataaattatatgtctttgctttgttacaggctatttgtcactataacacattgaaattaaaagagccatctttgatatcattcttcaacaatgtattcccttttgtcactactctgtacattttatttctttttagaaacaaacacactttattgatttctatttttgaaacatttaaaatggtctttcatggcatttggttatatgttaggtagagcttcttaagttcaaaaataatagttgaatagatttctttggcaaaagagattgtggtttttcccctccttataaatctctttttaagaagcaaatttcttgcacacgtgcaataatttgaatccatgtaattttggggacagagacgtaaaaaacataaatgattcagaaatttctagttgttatatttttaatgtacagctgactgtcatgatgacataattcagatatttgtcccccaaatcttatgttgaaatataatccccaatgatagatgtgaggcctgatgggagactatgggatcatggggacagaatttctccttaatggtttagcactatccccgtggtcccgtccccgtggtctcgtcctcatgacagtgagtgagttcttatgagagttcattgtttaaacatgagtggcatcttcccacttctctctcttgctcctgctttcaccatgtgacctgcctgctcctgcttctcctcccaagagtaaaagccccctgaggcctccccagaagccatgcagatgccggcaccatgtttgtacagcctgcagaaacatgagccaatttcaatttcttttctgtatgaattatccagtctcaagtattcctttataacaatgcaagagtgggctaacacacaaggtgaaaatatatatttagtagcatgtaatatttgcccatggcaaacagatttattgtaggtaagcaaagataataaacacttggcttcacttggaaggttccctataatctgccagctgaggtgggtgatgcctggcataggagaccaggtggccatagtgaaataggtagggttgtctgaaggctgcattcacaaattaaatgtatcccaccacacatgtgatgatgtcttagcaaaatccagcaaatgtagtcactgaagagttttctccattacttctgagagtttactaacaaaaagagtaactcctaaagactgaagaagagcaaatgcagaatcctcttgaggaaaaaggaggctggactaaaggaaaagtagccttttaaacttggcaacatattacatattacagtaataattcatccaagctgacaaattcagtcaacttcaactggctttctttcataggagagtgattgctctagaagataaggaacaaagtataaaaagtaatgtgattccaccttattgaggctaaaggttttatctcacagaatgtttatctgaacattgcagaaatatgatttcgctcaaagagctcttcggttaaggcagaagtgagtgacaggaaaactaaatacaaaagattttctaaataatgtaagtaataagggagtaactaaatttagtatgtgtgtttggtggtggcattgtgagagagtatatatgatgttcattaaatggaagaatactacaagttggtgactaatttaatgaaatagagttataaacataatgcagatgctaccataggagaatctactcgaggataaaacaagtggggcaaatataaggtgagtaaaactagatttctagaagtggggcagaaaatgatggaatagcaaatatagatgagataatgaaaattattaatcacaatctaaaaaatgtagaaactctttgttctcagcatggatcaaacaactccctctcctaccagcaagccttccgaaaattacatatcagaaagaactctaattagaaaaaaaagaaacccaacagaagacattttgcaagaggcagaatgtattcattttactaggtattccaatttagcttggggatttactggaagtgtgaaaaacttgaaaagggctcccctagaagtacaaataaatagaaaatgggtcaatagggaaaggggattttatctggaacaaaatataaaatagaatgaaatcagtgaataaatgaataaataaatgaatatataaagtgatacagcactaacatttttagcaactcttcttggtctctaaaagagaccagtgagattttcaaagtggaacaaatggctgtgggattgtttgggatggatggtttctaaattgccagaatgaaatctagggcctccagtatgaagcatatcccaacttggtgttcttggttattttttcaaaatacgtggctgcttcaggacagataatgaagttactccatgtttcttggagactgaactggaaagccagtgatccagattcttttctacatccttctccctcttttctacttttcttggcttgtctctggtttatctgtttctttctctcccacttcttataggcttcctcagttttcttttctcatagcctatgtggatggctcctctctggccctgctttctgcatccttacattttgggtgtagggtcctccactctgataataccttctatgtctcctgattaaatttcttaaggcatagaatctccttagtgtttgactcaaattggctggccctgggtcagtttccttcctggtttcaatcagtagttgccagagttggaaggtggaattggatgccagaactgtctttttcaggtactgcagtcagcaaaccctggttaaaaggcaaaagatcaatctagaagtacaaagaaatgaacaatgcagtagtgggtgctcatttatttattaaaagcagttcaggccatgcacggtggctgcctgtaatcccagcactttgggaggctgaagcgaggggattgcttgagctcaggagtttgagaccactctcggcaatacggccaaacattgtccccacaaaaatacaaaaattagcagggcatggtggcatgtgtttgaagtcccacctacttggaaggctgaggtaggaggatcacttgagcctgggaggatgaacctcaagtaagtcatgtttgtgctactgcactccagcttaaatgacaggtgagaccctgtctcaaacaaaacaaaacaaaaaaccaaagaaagacaaaaaaagacaaacagctcaggagtttgagaccagcctgggtaacatagtgagaccctgtgtccctaaaaaatgaaaaatgaaatgggtggattggtgctcccctgcagtttcagctagactgaggcggaagagttgcttgagcccgggaggtgaaggctgcagtgagctgagatggtgccactgcattccatcctgggtgacagagtgagactctgcttcaaaaatcaaacaaacaaacaaaaaccctgatactgaactcagataatattcagacattgaattgaacgttgggaataaagtggtggacaagaaagatattctctgtgcaatgaaaccgagtcattcagagttttacaggggaagactcatcctatagggctactgctgacattttagaatagtcctttagaaattatgagagactaagaatgttgtcaataattttattataataatgtgtcaattacagaactcatgtcatagaattttctttctcttaatatattaattttaatagattgtgctctgcatgcttaaaagagaagtgtttttttcacctggagttttaaatagaaaggtaagccaagaggagtgtgataagattcttggaagataacatgggcatttgaattgcagctatcattgatttaaaaggtacaattacatgtctggaaaaattttcagaagttgtaactgaaacttggacactgaatgtatcaaactgtattgtatcaaattacagaagctcaaatcaaagtttggctcattagatacatgagtttgcgaaagcagtctttttcatttatagaaacctagttgcaataataacaataatatcatggtaatgataatggcaataaatcacatgacatttattggcttttaggatataccaaagacttttgtggacggacactgacatggatcagttactttaattttcacaacagctcttatgtgtattatgatcatttcataatttacaattaaagaactgaagaagagagattaagtaaactgccaaacctcattcaactattacatggtggagccagggtttcagcccagcagtctgactatagatccatcaagattttttagttttacatgaacacacataatcagacattatcaagtaactttcaacacagtactacaagtaatactttgcatttccagatattgatggtcttggtaataacccatggaatgcgatactcacgaagaataaaatgtagcattttccactaatattgtgcaatgaagacagtactttctgtggacataatttactgaataatctttgtaagaagtgcctttaaaattgtctataagcattttacattcgtgctgtgttatacagcattgtttttacctgcaaatttattatataaatggtttatctgagagtacagacttgatatttaaacatgatgacaaataaaacattctaaaaattgagtgattatatttgagtttcagaatactctttagtttcttttttttgccaaaatgagactgttagacattgcgtctttaaaacttccatgatttgataaacgcaatactcagcagtcagaacttgtttttagaaaacctacctgcctttttcaatatgctcttgctataaaatccttatttgaaataaattcttctccaattcagccataatattaattactcagttgctcagatatcaacataaattgagaatgaaaactacagaaggaaacacatcagattattaatgattattttcatagatatgaaaaagaagaggtcaagattgaggatgatgagcagagatgaccgcagtattatacgtattttttacagaagaatgtattcaagtattacatgtgcatttaaaagataattcaaaaaacacacaatatcttcatttcattcagagggtcatgactggaagagagacagctattttgtcctaaaaatatagtactatataaaactagtcaatttcaggtccctgaatttgaatatgtagtcaatatctactaaagggataatttagtgctgtgtaatttttaaaaaaaaatttttaggctagatctttggaaattattattattattattttattctgcacctgtgtgattttatcaattagcttaggcatgtgacttaggttctaccaataagaagataagttcatttggagaaatgagaggagggaaccaagcttgggagaactgatcttctgacaagtggaatggcacaccaacttgtttgttgagaatgacagaggtggaagttcttgtggttgggactgaacctggcaggcactggacagcagaggcaggtgagggttcagcagcacagctctcttggagtggttttgcattgtcgcaactgcagagcactcgtgcctggatcactggcactatgaaccaagtgacttcatttagtaaatttttcttctgtatcaactcaagagactagattttgtcttttacaactaagaatcctgagtgatataatagcattttttttctagtttatccacctacatcgtactcttctcattggaagaagctattgtggttctttgtccccatatcatcctttccgtagaagtatatattgaaaattaactcatagatgaaatagattaaatagaatatgtgagaaacaagtcttcatttttgtaaagcgagcgtaatacaggttttataggtgggatttgggagggtctatcaagtttatcttgatagtctttgggcaaaaagcaaaggccagacatttgcaaattatttccaaaatgagaatgtagaaaggaaaaaaaattgagaacaaatgttcctaaattcataaactcttttattttataaataaaaaagttaaggccaaagtaagcagtgtttgttacattgttaaggactgtcaaagatgaatctgaaaacttctagagctgttattccatgctctttccatttcaccatgttttgcccttcatgaaaatacttatgttcttatctgcattactgttgctgtgtcctttaagagcaaatttgggaaaattcagcttcaggctttttatattttctcttactgcctctatcacagctcctgaaacccagacttgtgaattaattagtccatttccctttgtctctcctagttccactctcaggagaaagataaccgcaacaatttgcctaatggagttgtacggtatttcaaggtatgtccacctatgatattgattaattttaacatctgtcataatttattctccttcattctggtcattaccacccacagtccttctcttgagtgagatgtttgttattctgccgttcgttggcctttggcccaacctctcctaattactgaggaaacaggacttttctgcttgattttccagttctgtgtccatttgaaagcagaatgtcctttctgcattggcttattcattcaacaaatagtcactgaaagtgcctaagaagagcctgacagtgttctaggctctaaagatacatcccataaacaaagtggacaaatttcctgtaattgaggagttcatattctactagggaagacaaacaatacacctactaagtaagcccattaatatgatgagtcagaaggagactagtgccagagaaatactgagcaaggcaaaggggcttgggtagaagcaataacgtccattagcattagagaatcgtcactgggaaattgacatttgatcaaagatctgaagaagcgcgaagatggagaggaggtattgaagattttcagagagagagaggaggctgcaaaattgttatctgattgaatgagagtgaagggacttgggaagtgtattaagaaatgtaataggattcctacttagggcctgcttaaaatttgtgggcattaatttaaagcgagacaagtctgaatacttatggtgtgggtgtgtgtttgtgtgcattcatccacattcagttacacaggtgcagacgtgcaaggagaaggcaggaagctggatttaacaagaattgtgggtatgaagagacaagagagggtcaaaatattgagaatatgacactattgattaaccaggaaatttatattgaagatagagggaagcaaggcatattatggagatgacagttagaaggtggaagaaacaactaatcgtatgtcctggtagcatcaaaagattcttgaaattttatcagtaatattgacaaccacactaacatttattaaacacttactggccgggtgcggtggctcacgcctgtaatcccagcactttgggaggccgaggcaggcggatcacgaggtcaggagatcgacaccatcctggctaacacggtgaaaccccatctctactaaaaatacaaaatattagccgggcgtggtggtgggcgccttgcctgtagtcccagctactcgggaggctgaggcaggagaatggtgtgaacccggggggcggagcttgcagtgagccgagatggctccactgcagtccagcatgggcgaaagagcgagactcagtctcaaaacaaaacaaaacaaaacaaaaaaaacacttaccatattctggacatgatgccaggtgttctagacggactttgttaagcttcgtgatagccatatggggtcaataccatattataatcaacctcattttgcagaggaatttgaaagtgaagttaaattgggggtaataataatgctggccctctctacctcactggatcaattacattgagataaagggttttttacaactttgaaacctgtaaactgccatacaaatataactactattcaatggataggagacttgaacgtatacagcatgtaatctaattaaatggctaaagatagcaacagtgacaagtctccagtatcttcaaacgtaaagctaaaaatatcctgtgggttcaggaatatgtttttatttctgtgttcagtaatttgacttttatgtacattaaaggaagcacagtatgagaatctaaggaaaattaatctattaagataggatgttttaatttctagtggcttactatttttctttaagataatggacttccgttttttatttattggacttcaagacacaaaccagcctttaactaaaattttactatatttgtgttcaattccagaaataagcatggtcccttccataaaaatgtcaaatggtgggatatgtatttaatagtggatacagaaagcctaatacaattatcaaaggcttatatgaatcaagcagtttttctagataagactccgaaaagaggaaattaaagctcatcaaatgggctcataaaattaaactgtaagctgataaagagctacctgcacctaggatgtcctttctatcatttgtaatctctctgttcaacttaagaaaaatgactcagcaccccatgtgcaatgcatcttgctgagaagaagccattaccagaggataaataatttaagtgttccctctgggattcaaagcccctgggccccagatatcccagttgtcactgcagggaataaaataaccagagctgcactttcttgataattattttcttgcatcctctctcctttaagttagcggacattgtatagccactagtttaggtaacttctctaacttacccatgtaattggtggctttaaaaaggagtttataaaataactggatatggcaccaaactaacctccatccatgagtatttttttttgaaatggagtctcactctgtcactcaggctggagtacagtggcgtgatctcggttcactgcatcctccacctcccgggttcaatcgattttcctgcctcagccttccgagtagctgggactacaggcacctgccatcacgcccatctaattttttgtatttttagtagagacggggtttcaccgtgttagccaggatggtctcgatttcctgaccttgtgatccgcctgccttggccttccaaagtgctgggattacaggtgtgagccaccatgcctggcctatccatgagtatttaaaagatgacagtggggaagaaagaatagttttattcagctatcatgtgtgccacattaaatcagggcaaaaaagcagaaagcatcatctgaggtatctaattcattcccatagtaacggagggccatcagttgtactctatttctcagtgcttcttccaatagaggctgccacttttaatcgatgtaagtgatggaggcttcctgaattctgctaggaagttagttctgggctaatatacttcatagcttttctctcaacctcatttcatcccaaatatgcttagaaaacacagcaactttatctttatgtctttctttcccttccttaatatatctctccagagtctctatgcaacaacacagagcatttgactttaagctattcatggttttctctcagtgaagagaaacaatgtattgatacatgaaggactactacctctgaacactctatagcatataagccatggaattcttagaaataccctggctttatcctatccctcttttcatttttctgtacgcaagttgctttgtcttgcttccaaacttcaccaaacaacaaacaggaaccacagtgaaaaaatgggtagatgacatgaacatgtaattttcagaaaaagaatcttaaaagttaattagtaatcaaacaatgcagattaaaatgactgtgagataccaagtgactgctttttagacagcttggatgatgtcaagtgttagaaggtatgtgctgatacagagttttcatccactactagtggaaatggagaaatgatatggtttggatttgtgtccccacccaaatctcatattgaattggaggaggggcctgttgggaggtaactgaatcatgggagtggatttccaccttgttctcgtgatagtgagttctcatgagatctgattgtttaaaagtatgtggcacttccccctcgctctctctctcctgccaccacatgaataaactgcttgcttccccttcaccttccaccatgattgtaagtttcctgagacctctcagtcatgcttcctgctaatcctgcagaactgtaagtcaattaaaccttttttcttcataaattactcagtctcaggtaattctttgtagcagtgtgagcacagactaatacaagaagattccacctatcctagagatcaatctggtagaacttaactaaattaactatgtgtgctctgtaagattcagcaagttttctcctggacatatatcccggataaattattttacaggttcatagagaaatgtacaagaggctaatcatcaaagaagatttgtgatggcagtactaaaggcaggcagggtgtccatcagtgggcaaactggttagagtaaatgtggtgggctcccaccacagactactctgcagaagttagaaggaatcaactagataagcccacagcaacatgaaatgatcctaaaaataagtttttgaatgaaaaaagtaagagtaaagtagataacactatttgaataaattgaatctacgctcatataaaataaaattatacattttgcaagaacacataaaaagaaaaacatagacattgagcacttcagcatggtagcatatgtcaatggagaggaatgtgtatggagaaaggcgataacagggaaaatgatgtagagataaacaaataaatgaaacaataggattgttttatgtgtagttttgcctactctagtttagacccctcaaaataaaataaactttccttgtcaacctacccagctcttctcagccacttctctttgcatggacactgaattttctttcctgctatatcagctaaaatattgtttattcattttttaacattttattttagaccctgatatctaggcattctttgggtttcaaaaatcttcccatgttagtgtcataattaggcttgggatttcacctgagatattccctttttgattgaggaaatggaccatttgattttcctgtccaaaacctttaccctctattttcaagatcaaaaaaaaaaaagaaagagatgtccttgaggttgggcaagaaggtgcagcggcctttacagaggcattttgataccatggagtggattgcctcaagagggcctctgttctccttaatgcttcatttgagccgtttctaagatagtggtgctccaatgtcacaccttgggaatgaaggaccctgaccctaagcccaggctgtacttccatccctatctttgtccaaatgcattcgtattacatttttttcttcttgaccctttgcttcctccgtcctctttctatttttagcccagccccttaatgcctgggcttatttctcattcctctcagtatttctctcaatcagcacctcagaatcattattcagctcttttgagagtctttttcaaattcttccctagaacatgggctggattctaccagtgcttcctgacttggagtttctcggtaataaaggtcaatatattcttagctgaatttcaataagaacttacaggctatctgaaatatttatgcactttcaagatatgtattggatttgtttaattcacaatagtgggttgaaattcatgcctacccagaacctcagaatgtgatcttatttggaaatagatgtaattatgatcaaaatgagattacactggattagggcaggccccaaactcagtgaaagtatccttataagacacaggcaaggacccacacacacagagatatgaaggcagatattggagagatgctgccacaagggagataataaatactttgttgttttaagctaccaagttgggggcattttgttttggcagccctaagtaactaataatatttaatatgatgcacagctagttatttcatgacaatcagagtctcagataggttatacatatatatcatttattaataaaaaataaaatagttcctatgctactgtgattatatatgatgcttagtaacttgtcgtccaataggactgaggagtacaatatctcacagtagttaagagcccagaggctatagccagactgtgcggattcaaaatacaattcttaatcctgggcaatttgttttaacacctctgtgcctcagttctcttacctgctaatggacgataatagtacttaccttgtaggttgttgtaaaggtatggttaaaatatggtaagcacttagaactgtacctagcatatagtaaatgtttgatactattataatttcatgaagatattaatcttcaatgcttccttattattagatttattatatattactcaacatgtaaattgggtaatagctattgtgtgtaaagtgcacagataacatgggttggtgagcagggacctgcctacctcaggtaattttgttttactgtaatacacaataaactaagagattaaaattttcattgaatatatagattgttaataacctaatattattaatattgagcctaaaataatattatttgcattattctaccatttatagattaaatagcactgttaaattttccatgatattctagaatggcagattcaggtaatcaaacaaaatgtttccaattcattttgtatttcactgcgctgtacaatgggatttattttggaaaaagtataattttgagggtaagaagaaaatcttctccttaagatcatataagactgttctgaaatattatacttatatatgtaataaccttgtagctttgtgggttttttgtcttaactggtacatttagtattcttctctactgtgatattgatgcctaatattcaatctcacttcagtctagttcacttttgagttttctaaatatatttttcctttccttctatttagttgtgattcatttcactcacataattaagcttctgtgcgatctttactacccagaaacccattagatagtaatattagtgagcctgtacttcaaatatttcagtgcttggaaactacacacaatatttgataatctgctgaacacttaccatatttaaaccatttatgccagaaatcgcaattttttgtggaaaatcagaccttgttgatgaccttgtacagtaggatataaataactcccttaagcttaacgttccaataatggaacactaggcataagtgggttttaagcacattactagtttctttatacagttgatctttaaacaacatgggtttgaactgcttgggttcacttatatgcagatttctttcaaccaaactttgtaaatagtgttcacaggatgtgaacatatagatgtctggctttttacctaggcagattccacagggccaactgccggatttgaatatgtacagatttgggcatatgtagggcatcttggaaccgattccccacatatactgattgatgactgtgtgtgtgtgtattttcttgtttgtttgtttgtttgtatttgtgatggctagttttatgtgtcaacctgactgggccacgggtgccaggcatttgtttaaccattattctgggtgtttctgtaagagtgtttatggaggagattaatgtttgaatcagtagacggagcaaggcagattgccctcacagatgtgggtgggccttatccaatcaattaaagacctcaacagaacaaaaaggctgagtaaacttggcctgactgactgttgagcaaggacatcagtcttctcttccctcagacttgaactggaatgatatcattggctcttctgggtctccagctggccaactgcagatgttgggacttctcagcctctataattgcatgagccaattccttataacatctctgtgtgtatatgtgtgtgtatatatagatgtacataaatgtgcatatgtgtacatatacgtatatgtacatacatgtacagaaatgtatatatacatgtgtgtatatgtacatatgcacacatatgtgtacatatgtatgtatacacatatatacatagacatacatatatgtacatatatacacatacataagtatatatatatacatatatacgtacgtgtgtgtgtgtgtgtgtgtatatataaaatgcatgtgtgtgtgttctctttctgtagagaaccctgattaatacagcaatgcaatgcttttgcatgtttggcatgtgtgttggtccattttcatactgctataaagaactacacaagaccaggtaatttatacagaaaagatgtttaatttactcagttcagcatgactgggaggcctcaggaaacttacaatcacgggagagggtgaaagagaagcaaggtatgtcttacatggtggcaggagtagagagagcgaagggggaactgccaaacacttttaaaccatcagatctcatgagagctcactatcataaggacagcttggggagactgacctcatgatccaatcacctcccaccaggtctctccgtcaatatctccacaatttgtaattggggaatacaattcaaaatgagatttcggtggggacacagacccaaaccttatcagcatggtaatctttattttacagactagaaaattgaagcttcttcagaaaagttgtaatcctaaattcacataacaaatagatagtgggtctggagtttcaacctaggtctgcatgattccaaagcccctacagtctccacctcagcaacaacacctcaggtgttgaattcacaacacctgctcaagtgagcgagcacttggagctagtcttgaatttactccaaaacatattagctcatgaaacatttccccacagaagactaattgtctttgagaagtcacacatctttctacactcatattacacagctccttaattccattcttagttcatgtggcctgcattctctggaagtgtactgcagttcaaggatgaagggacaaagtcaatttatcattcactgtgttttattcatgcagtctgctttcacccccagaaatagataaaaattggtactatttattattcttaaaaattccatatattctccttgaatctacagtattcaaattcataaataattccactgcttgatctgaacaatggtgaggggactttcaatgacaactttttatgaaaaataattaatcaagatcaccacacataaacagaactaaagacaaaaaccacatgattatctcaatagacacagaaaagccctttgataaattcatcatcccttcatgttaaaaacactcaataaactaggtattgatggaacatacctcaaaataataaaagcaatttatgacaaactcatagccaatttcatactgaatgggcaaaagctggaagcattccctttgaaaaccagcacaagacatgatgccctctctaaccactcctattcagtatagtaatggaagttctggccagggctatcaggcaagataaattagtaaagggcattaaattagaaagagaggaagtcaaactgtctctgtttgcagattaaatgatcctgtatctagaaaaccccatcatttcagcccaaaggcttctcaagctgagaagcaacttcagcaaagcctcaggatacaaaatcagtgtgcaaaaatcacaagcactcctatacaccaacaatagacaagcagagaatcaaatcaagaatgaactcccattcacaattgctacaaagtaaatgaaatacctagtaatacagctaacaagggaagtgaaggacctcttcaaggagaactacaaaccagtgctcaaggaaatcagagagaacataaacaaatagaaaaacattccatactcatggataggacgaatcaatatcatgaaaatggccatactgtgcaatgtaattgatagattcaatgctattcccatcgaactaccattggcattctttatggaattagaaaaacaactactttaaaattcatatggaaccaaaaaagagcctttgtattcaagacaatcttaagcaaaaaaaaaaaaacaaagctggaggcatcacactacctgattcaaactacactacaaggctatagtaaccaaaacaggatggtactggtacaagaaccagacacatagactgatggaagagaatagagaactcacaaataagactgcacatctacaaccatctgatctttgacaaacctgacaaaaacaagcaatggggaatagatttcctttttttccttacatcttatgcaaaaataaactcaagatggattaaagacttaaatgtaaaaccccaaactataaaaaacttagaagaaaatctaggccatactattcaggacataggcatgggcaaagatttcatgacaaaaacacgaaaagccattgcaacaaaagcaaaaattgacaaatggcatctaattaaactaaagtgcttctgcgcagcaaaataaactaccatcagcatgaacagacaatctacagaatgagagaaaatttttgcaatctatgcatctgacaaaggtctaatatccagaatctataaggaacttcaacaaatttccatgaaaagaacagacatccctattaaaaagtgagaaaaaggcatgcacagacacttctcaaaagaagacacttatgtggccaacaaacatatgaaaagaagctcaacatcactggtcattagataaatgcagatcaaaaccacaatgagataccatctcactccagtcagaaaggtgattattaaaaagtgaagaagcaacagatgctggcaagactgtggagaaatgggaatgcttttacactgtttgtgaaaatgcaaattagttcaaccattgtagaagacagtgtggtgattctccaaagacctcaagacagaaatatcatttgatccagcaatcctattactgagtaaatacccaaagaaatgtagatcattatattacaaagatacatgcatgtgtatgttcattgtggcactattcacaatagcaaagagatgtagtcaacccaaatgcccatcaatgatagactggataaagaaaatgtggtatatatacaccattgaatattgtgcagccataaaaaggaatgagatcatgtcttttacagggacatggatggagctggaagccactgtcctcagcaaactaatgccggagcagaaaaccaaacaccacattttctcacttataagtgggagctgaacaataagaacacatggacacagggagaggaacaacacacattagggcctctcagtgtggtggagggagggagagcatcagaaaaaaatagctaaagcatgttgggcttcatacataggtgatggattgataggtgcagcaaaccactatcacacacatttacctatgtaacaaacctatacatcctgcacatatatcccagaatttaaaatgaaataaaaaagatcacctcacttgcaacttacttatagtatacaggacgcttgtgagtctaaatattatttcaagatctatgaatcttctttgtgcttctgttcttacaattccaaaatcgactcatttctttgtttcttttagttaatagaacgtgtattttttcatgaagatgaaattattgctacttgttttctatctgttttgccagtcatttaacatcttaaacagttttgatgcccttccatgttgtatcttttattattcagttttcatttccaatggactaggtttgagctctgccttgaaataatcttgcaattgttattgactcccttttgcaaaattaatctaatctgtttttggccgacttccagggcagctatttaagcagctattggccaggttttattgcctcctggctttaattcattttcatacaggtgtactccatttctgtttaaaagggatcaagaatatcttcaaactaagagctcccctcctttggaatcctgtcactgactattatatatatggcaccctttcatcttcaaaagtaaaaataacccaaaaagccaccttaaaatgcttcttttttgtcagcaaaaactcactccaagaactatttcggttctataaagctcttattgtcttcaattactgctttttcttcttcttattcttcttttttatcttttggtgtactctcttgctgtgtcctgatcccactcttagggatattctgtgaggtcacctgctttccagtctcactctttcaatcctttatgagctagcagggcttaacaaaagaaaaccatttaatagttttgctacctaatcttaacaccttatttttcaaaggggtttcttacaaatgcttctacttcttatcagatctgaaggaaagagtatctcaaagagcagcccttaagcacttgccaattaaatctgggctatctcctataatgtttttgagctctttttgaagaaagatttctcaatgcctcagatctgttaaattgcactctttatattaccattaatgccacaaggggtttgtgacctctgaataagttttttgagatgaattttcatagcatatatgacttcaattttaaattcgtcagtcttttttcctgtacaagaaaatgggaagaaagagtattccattttctgaaacaaaagcctatatataacatatactttagttttacaaccactcaaagcttatggaaaatacaggaaacctcatgtaacatttttgcaaaggatctcagaatagcaaaagaatatgcagaaggtgtcactgaaaacagcacttacatcctaaaattattagtccattttcatactgctatgaagaaatacatgagacggtgtaatttataaagaagaagaggtttagtggactcaaagtttcacatggctggggaagcctcacaatcatggtggaaggtgaaggaagagcaaaggcatatcttacatggcagcaggcaagagagcatgtgcagtggaacttccctttataaagccatcacatctcgtgagacttattcattatcatgagaacagcatgggaaaaacccatcctcatgattcaattaccctccattgggcccctcccacaacacgtggtgattatgagagctaaaattcaagatgaatatggggtggggacacagctaaaccatatcagacccctaaaccacagagcatgtcatataatgtctgtttaacatactgtattataagtgctcacgctttgttagctgaataaagaagtgatatggattcaaaattttaaatccaagaacagtatgtgattattccccactcttatgagcaagaggcatctatctgttttaacacagtaatcttagtgaaataaatactaaaagacaatcaagagaagacctctacttctggaaagataaagtagatacatatttttctttattccacctgctaaatacacctaaaaattttcaatagtgtacataaaaacaaacataagaagattgagaggtagagcaaatgaaacaaaccattcagggaccataggacctaaggaaggactcgttttctttttgcctcatgtatcctagagagccggtgtattagtctgttttcatcctgctataaagaattgactgagactggataatttataaagaaagcaggtttaattgactcacagttccacatggctcaggaggcctcaggaaatttataatcatggtggaagaagaagcagtcacgtcttacatggcggcaggtgagggagaacatggaagagcagggaaaactgccttataaaccatcagatctcatgagaattcactcgctatcatgagaacagcatgaaggaaactgcctccatgattcagtcacctcccactaggtctttccctcaacaccaggcaattatgattcaatgtaagatttgggcggggacacaaaacctaaccatatcagctggcaacctgggaaagcctcagcataaacctgctccctctagccaaaggactagaaaaagggcagtcttgcaagacaaaagtcttttagacaataatgactctactccagctaaacattacagaaaaaactgtgaccctaccctgacccatgccagaaaaggctgaatggatatcctagagagccatccatcccaggctgtaatgaagtgccccaactcacctgctgatatggtgacagagaaggttgagcagggagtggagactttcttcttcatagagcagtgacaggcacattcttcctcacaggagagtaacagcccccatcccacaggagtcaggagagatcatctgtggaacctggacctcccccaacactttctttctcctcctctctggggtgttgtcataagaggtgtagtggaaagtcagggcttccactaccaaccggaaataatgaagcaacttccttatcccttgtgttatcaatgaaggttgtttggagaggtagtaagacactcctaaccctcccagccagggaggtctcagtggaggtctagtgagtaactaaaatttccacttctggctaggagcaaagagggagagccccctgtcttaattatcaatgaaggccaagttgagaacctgagcttttacctttgcctggaagtaatgtagtaagatcccctttccacctgtcagagtggtatcagagaaagccagctaaactagaaggtttaaataagatccagaattgataatatggtacccagaatgtctaggattaatttaaaaatcgctcattattcaaagaatcagaaagatctcaaacgaatggaaaataaagataataaatagatgcaacattgagaagacagagatgctagagttatttgataaatgttttaaggcagttattactttttgactctcccttctcctccctaaagtagttattttaaaagaccttcaaggagtaattatgaacatacttaaaacaaatgaaaaaatagagtcacagcaaagcaattgaaagtatcagcaaatgagtaggagatataaagaagaaccaaagagaaattttagaactaaaaaatacattgaaaaaactgaaaagattagcagaatagagaaaacagatgaaggaattatggaactataagatagaacaatataaattacccaatttgaacaacagagagaaagactgaaaaaaaatggatagagtttcaggcactttggaattgtaacaaaaggtctaacttttgtgtcataggaatcccagaaggagaagcaagagagggcagggctgaaagaacacttgagtataaaataatggtttaacggttcccaaatttggcaagagttataaacctaaagttttaagaagtagagcaatccccaaacagtgtaaacccaagccgatccacactaagatatctagcaaaacttctgaaaactaaagattaaaaaacatgagtgagagagaaaaaaacaccttatctgcaacgggaaaacattttgagtaacaagggatttcttattagaaaccataaagactggaaggaagtggcacaacattttttatgcccagtgaaaatatctgtcaggaatcaagggggaagttaagacattagagattggaaaaaaaataactaagagaacttgtggtcaggagaactaatctaaagtagtgactaaagatgttctctgaacagaaaagaaatgattcaggcagaatcattggaaaatcaggaaaagagataaaacatggtaaacaaaatatgagcaaaaacaactgattttctttgtgttttttagtttttgaaaatgaggattgatgcaaaatttatgacactatttgatgtggttctaagactgtattagaaaaaaacacaatgattttataagtggaagaatttaatgattttataaatggaagaacacaaaggaaggcaagttttttacacctcacttgggctgataaaatgatgacaccagtagattgagataagttatgtatatataatgcagtacctatggcaaccaccgcaaaggtttacaaagaggtgcattaaaaaataagttaaaatgaaattctaaaaaatgttgaagtaatccacaggcaagaaaaggaaaacagaaaaatataaaacagagaacaaacattaaacaacaacaaaaaacatatgtaagccctaaaatattaattattacattaagtgtgaatggtctaaatcagcagtccccgacatttttggcaccagggaccactttttttttttttttttttttttttttttgagaaggagtcttactccgtcccccaggctggagtgaagtggcaccatctcaactcactgcaacctctgcctcctgggttcaaacgattctcttgcctcagcctcctgagtagctgggcttacaggcatgtgccaccacgccaggcaaatttttgtatttttagtagagatggggttttgccatgttggccaggctggtcttgaacccctgacctcaggtgatctgcctgccttggcttcccaaagtgctaggattacaggcgtgagtcagggcgcccagcccagttttgtggaagacaatttttccacagaaggggccaggggtagggggcagggaatgggtttgggatgaagctgttccacctcagataatcaggcattagttagattctcataaggagcaggcaacttggatccctcacgtgcacagttcacagtaggttccacaataggctcgtgctcctgtgacaatctaatcctggcggctgatctgacaggaggcggagctcaggcagaaatgctggctcatttcctcctgtgccttccagtttcgaagaggctacagaccagtatcagtctatggcccaggggttggggactcctggtaaattcaccaattaaagacaaagattagcagcatgaattaaaaaacatgacccaactctacgctttctgtaagaaactgacttcgtttataatggcataggttgaaagtaaaatgttggaaagagatctgtcatgctagaacaactaagcagaaaatcagcaggctataaaagaactcaaaaacatcgtcaactaacagaatcaaattgacatttaaagagcgctttatccaatatcggaagaacacacattaaagtagctacctccccttatctgccatttcatttttcacagtttcagttacctgcagtcaaccgcatagtctgaaaatattaaatggaaaattacagaaataaacagtttgtaagttttaaattgtgtaccattctgagcaatgcgatgagacctcatgctgtcctattcatcatacctgggacatgaatcagcccttggaccagcgtagccatgctacctatttgttatgttacctgtttgttagtcgctgattaggtgtctcctgtatcagatcaactgtagcactgttgcagtgcttgtgttcaagtaacccctatttttacttaatcatggccccaaagctcgagtggtagtgttggcaattcagatatgccaaagagaagctgtaaagtgctccctttaaataaaaaggtctgtaaagtaaaaactgacttaagtcaatttgactgtaagtaaaaattgacttaataaggaaaaaaaaatatatgccgaggttgctgagatccacggtaaaaacaaatcttctattcatgaaattgtaaagaaagaaaaacagtttgtgctagtttagctgttgcatttaaaccgcaaaagttacagccaaagtgataataagtgcatgataagtgcttagttaagatggaatagccgttaaatttgtgaatggaagacatgaacacaaacatgttctaattgaaggcaatcagggtcagtactatctgcagtttcagtcatcaactgggggtcttggaacgtattcctcatagataagaggggactactgtattttcaagtcctgcagaatatatatcaagatataccatatcctgggttataaaccaaaactcagaaaattggaaaaactggatatcatacaaattgtgttcaatcgataaaattatactagaaatcagcaacagtaaaatctttttccaaacacttggaaataaaacaacacacttttaaataatccataggtaaaagagaaagtgtcaagtaaagaaaataaaaatacaacatataaacatttgtggggcacatttaaagcagtatgaagaaggaaatttatagcactaaatgtatacactagagaagaaagtcttaatactttaggctcccacctcaaaaaacatacaaaaagaagagcaaaatgtacccataccaaaataaaggaggaattcataatgataatagcaaaacccaataaaattgaaaacaaaaaataggaaaagttaattaaaaagcttggtttctgacatcaataaaattaataaatctcaaataagactgacaaagaaaaagaaaaaaatccaaattacaaatatcaggaataaaacaggatatcaccacaagccctgaatacattaaaaggataataagggaatgctagagaccactgtacacacaaaaatctgacaactttggtgaaattataaactgattcttcagaaaacagaactaccactactcacccaatataaaaatgataatttgtataagcctataactgttaatattaaagaaactaagtttataatttaaaatttccccaaaaaagaaatattcaggctcagatggtttcattgaagaattctcttataccaaatgttttaagaattaacaattttacataagctgtcttgggataagtagctttgtgatctaagaaaaggagaaggttactagatgatccctaaggattcttcctaaaggtagtctatcttgaaggaagaaaaaccctctgaaacctatgttaaatgcattactaaatatatgtcagtggagatggttgcaaacaagctatattggccgaggttctgggctttatccacagtatggaataatggaggggcagagaaaattcttatgttaatcaaaattgcttcaaattctcacaaattatgatgttttattataacagcttctgtattaaatacactctcattatatgaatgttttactaaaattaagctgacgatataaacacaatataaataaatagaacttgtgatttttcaataacttatcttcctgaatacattcctaactcatcttttttcagggtaaggtgattccaaactggaatttcccaaaggacatgcataacgtgtgttaaatgagttttcttatgttttcacccagcaatggataatcgtttaaattactttgtctatatcatcatgagccaatgtttttaagagccttggttctttcagaactttaagttattgacataaagttattgacatattaataccacatttttttttgcaatgatagtcacacttcttattaccctcatgactaagactgctattttctaattgagaataaccttgaagggtagatcatcagttgtgtttaatttgcttttgtatatacaatttttgtattcatcctcagaagtacccagaattgttatttaaattttagcttcctgagtactgagcaaatggtgtccattctggggcatgtgtatcaaagaatttaattacaatttttaaattacagtttttaattcagctgatcacattggtttaatatgtgagagataagcttcaaaatttaaactgtgataccctatagtctacagactatatggtttttggcaaaatgtatcctttatgtactggtgggactctgtttggagcaacgcgtagcattttattagtttaaaggctctgaaggggcattgtgaataacactacttcctcatttaacttactcaatatatttcgatgaagtacaccagtgggacaaaatgttgaagaaacacaaacttttaaagttgccagtgatttaatttaacacaagtttctttggtatttgcatacacagattgtattatttataattaacttccctagtcatgtattttcagctttccaaatccctcagtaagtatccttctgccttgttgaaaagttcagttacatatgacagcaccaatctggcatttaaatgtgacactcattttaatgtgacactcattcttcaaataatacacacaaagtgacatacaagaagaccatctactttgtgtcccctgtcacctctgcctgtggctcccatagattagcgactcgagggctgaacttgccactctatcacagtgagaacacgttcttttttccaattaattttcatgtaaaaaatgagataaatgatctctttttaaatgtttttttttattgttgctgttcctagaagacaatttactgtttgttttgattatattcaatgaacctgtatgggattgaaatttgctccaaaagctactttgaaaacaaaagaaaaaaaggagatttcaatacctcaacacagagtagattttagtggatactgtctcagtgtattgcgactctccattccatcataaagctattaatttgctctgttaaaaaaaactgttaaaacacaaaatatagccagtttctctttctccttaattacatgcctacacatagttccaacatcatgtcgaatcaagctggaaattttcagtttcttttttttactatattgatgagaacatatggtcactatttttatctcctgtcttatttcagtgcatttctgttattactgctcttcatttcagcaaccactgtagattctaagagtcacctatgtcaatacattttatatttccaaacatattgttcccaagtcgtttgagaagatatgaaaatatgcttctttagcttgttccatgataagatatcttcctgttgtcaactactaagacagaaatccaggccaaattgaaaatttgtctgacaagaggtaaatgtattaaccacattctcttaaaacttgtttgatgcagaggaatgattttgaagtactccaactatttcaatgactattagtaaatattagaaaagaaaatgtgagtaattcaagtaatctggctgaaactttgttccaaactggaatttgagcaaattacagtctcaaaggataagtagtgttaatttttcatgtttaccctggaagttcccaattaaataaatagaccattacaataaagacaatagaagagtcttaattaaacataaaggacaattgacccttataggttacatatgacaatattttagtaatcaatgtcccagtttgtctgggacttttccaattttagcagtgatagtcacaattctgagaaactactcagacctaagcagattggaatgcttggtagttctgtaatgaggtcattaaatttaattaaagctatctagtctattatatttgaaaagatgcaattatgttttaagataagtaagaatattaaatgcatattaatttaaaaatattgactgcacagtcaatcaagtttacttcaaatcatctcttttaagaagtaattttggccaggcacggtggctcacacctgtaatccgagcactttgggaggccaaagtgggcggatcatgaggtcagcagatcgagaccatcctggccaacatggtgaaaccctgtctctactaaaatacaaaaaaaaaagttagctgggcatggtggcgggtgcctgtagtcctagctactcaggaggctgaggcaggggaatcacttgaacccaggaggtggaggttgcagtgagctgagatcgcgccactgcactccagcctggtgagagagtgagactctatctcaaaaataaaaaacaaaaacaaaaagtaattttgttaatgaaaaactttgctttgggtattaaacaaataaatctgaagttgtaactaaaatagatttgaaaacacttatgtagtaaaataacaaacattaattgattcgactgtgttctaaaccctttgttaggctctaaaatagtaaagtaaataaaaatgtaattctttttctctaggagattatagctccaagtttctatggaaacaattttcaatgttaatattcagagtacataattaattttatacttacttatgtgtacataatgtccataactagttatagtcagcaaagattgatggttttctttttgttagaaatatagtgaaactatatattttcatcgtctacattttagacaaaataagcttattcttttggaagcaagagttatttgggccaattgaatatcatcgtaccaattaaataccaattttcagaaagtaatacataattgtatgcttgtgtgcctgaatcagaaacatccccttaaagtaaaaaagtaaaaaaaatacaaggaatatgcaaatatctgagaaatagcctaaggaattagcaggtgcacctgtaagatggttattttcctagtctttttataagatatttgatatttggatggcactttgtcttgcaataatgctaaaaacctttgtttgatttctagatcaaccaaagaaaccaatttcacacataacacagacaaaaattatacattggcagtcaagagaacatattttgtaattctagtggtaaagaaggacgcattaatgaaaacgtgtttagggtttctctacttgcaatcagtgtgatattttgacaatgtagatttgatcatgtcacttctctacacatacacgtcacacatatacatactctcacacatgttcacagttgaaactcattattggattctcattgctttaaagattaagaccaaaatcttccccatatcctaaatgctcctgaatagtgtgccatgagctttatcccatgagattctcgatagcatcttctaacttcagccacattggctttcttcctccatgttacacattcttttcactctttctagaaagttcagagccctctctttcctggattatagttagttatccctcaggtctgaatttaagctttgcttacctgagccccaaatgcaggtcagatttatttgcttatattgtttcctagaaccctgcttcatgacattatagcatgtgcctcagattgtttttgtgcattcattagtaagagtatttgattaatatctcttttctgcactggtcagtatgctccatgaggtcaggggccatgtctagttttgttcaccactgtatacccctagcctagcacagtgccttcattatttgataaataaatatttaaattaaagatttgttttatatactggcatttgagacaaagtgtattaattattaaaggatggcaaagaagatgaaaataactttaaaaagaacaacaggagagtgttagggttttaaaagttaatataatttgcttcttgttacatatgattttgcttcaaaactcatgactttcctttttattgctacaggtaggtacccaccaccccactaaaatttgtgagtcataattgagatgattatttttctcaaaaatgtctaatgagagggaggtgagaaacattttcaagtaattggataataatcagaagtgggaggagtcgatttagcaggatgtgtatttgtatctcataagaatttgggtaaagcaatatttgctaatctgagagtggttggagatcaaagaaagttgcatggaggtggaggtgagaagagtgacataaagtcaggtgattccctgagtcagttaacacacaacttcataatactcccctgagctggaaggagcaaattgtgagttaggatgggaagcagtgaataggttgcccctcatttgtacagatcttagggaaatcaactaggattaaaggttgttttgataatcaggtgtgtgtgtgtgtgtgtatgtctatatatatacatgtatataataaatctgcatgttttataagttgattaaattaacaatgattgaccaaatgaattgctatgtgttttttcataaaaacatgacaccatgtttcatggaaatccttagcacataaactgcactaacactaaatttaaaaattaatacatttctgtattaaaattgattaagtaacttagaattcagtatgcctacttgaactccacatagtgtagtttgacttaatacacaaataaatgaataaaatagaaagatacttaagtgacggccctgttccccaagataaatggatgtcgatgatacttgtaatgatcatcacagatggaaattaatagcttcccatagaatatcatttcagcgttaaattatggtgtaatcaaaaattattttgggcttatctaaactctcttgggggcattttaagctcctataactttattggtcattggtaaggatgaaatataattgttatgtgctctgattatggttaattctatgtatatttggaagaggcttttgcaatctttggtttcatattttacagtccaggtaagcttatgtgtccaatttatattcatgaaatagcttcccttctcttgaatacttttgtcaccttttttacaactccattaagtgtccacagagcccttttaaaatgtgaaagaaacataatgctcatcagcttagactggccttaagattataataattaaagctaggtaatgagtatgtgcttcctcattttactacttttatttttgtatatgtatgaaattttccatggtaaatgtttgaaaatttatcagcggagcctattaggtaaaggccaagcgtgaatgcatgtacatgtgtgaggtggtcgtgggagcgggtgagtagctggttcttcaggttttggattcagagttagtgactgcttcttggaactcccataactctgtgcttcattgattctggatggtgttagtgaaagtgaattttgcccaactaagttttgctccagaagaacgtgttgcttaaaatctcctggtctcattattttttatctgtaactatttatttgattccagtaagtacctgaagagggcagcttatcacctaacaatttttctaggcatttgctagtcatatgcctagtaatactacctgcatacactatgtcatccaccagggcacaacattagtcaaccctcttttgcacactctttctctagccaagattgtacagacatgctccacatgatattttgatcaacaatgggtcacttagatgccaatggttccataagattataaggaaactgacaaattcctattgcttagtgacactagccattgtaatgttgtcgctgaattacttttttaaaaaataaatgtagtatagttttagtgtacagtatttgtaaagtctatagtagtgtacagtaatgtcctaggcctgcacgttcatttatccctcactcacaggctcacccagagcaacttccagtcctgcaagctccattcatggtaagtgtactatataggtatatcatttaaaaaatcttttatagcatatttttattgtttctgttctgtttagatatgtttagatacacaaatacttgctattgtattacagttgtctacattaggagtaataggttgtactgtatagcctaggcatgtagcatggtgtactatctaggcttgtgttatgtacactctatgatgtttgcacagtggcaaaatcacctaacaaagcatttcccagagcatgtcctcatcataatatgatgcataaactgtagtttaatggagaaaacattcactaggagtcaggaaagctgggtttttaagattttgttggccaggcactgtggctcacacctgtaatcccaacactttgggaggccaaggcaggtggatcacgaggtcaggagctcaagaccagcctgaccaagatggtgaagccccgtctctattaaaaatacaaacaaaattagccgggcataggtggcggacacctgtaatcttcaggaggctgaggcagagaattgctcaaacccaggaggcggaggttgcagtgagtcgagatcacgccactgtactccaacctgggagacagagtgagactctatctcaaaaatatatatatataaataaataaaaataaataaaaaaaataaaattatttgttagccccagatgattgagaaaaattcacatacccatgtttcttggctcactaaaaattcatgaggcctaaactcatatctacaggtcacacctcttgtttatttcttattaaccctttcccatccctagacgttctcacgcttcagacctccttttatttgggctgtcaccaatacagacattcttctttaatgagaacaccaggtcctggattgcaaattctttcaattgtcattgtcttcctctttatgaatcaatgtcttcagtgtgtctgcatcattctcctttccctttttccccacttatttgtgactttgctcacattttctctgcctgaatttctctaccacaatttggttacttggcagaatcctggtttttactttagtcacaagcagaggtcagtggttacaaaacattttcatctgttcctgcggatggaatcaatgactcggccatctctgttcccacagcactagcttcagagctctatcggagtggagttttgtaaagtgattgtcttcatttgcttcattgattaggctgctcctcctgctaaatgatgggttccttgagggaagcacatcttttctaatttgtatccctaattccagtgcacagaacgtgggccattgtaataggcacttagtaaattttaaccagaattgaaatatttttcacctctgcctgaggaaaaactaaaaacatagtgcctcttatccaaaataataataacaataatctgtgttcttgattccatttctttccacattttaaaacacattgctttcctagattatcttttattttgtttgcattttctcttttccactggcttttgttttcttgttcaagaaatcctcacatcctgccattcaggggcttctcacttcccaaacctgaaacctctggtcccagttgtgcgttggctcactgatgttttttctctcccttctgccattctccataggttctcataatgcttcctgacaaatgcctgagtgctgggccagcagaggcatgtctgggaagaggaaaggagggggaaacaggcaatttccaccattcactcctccaaacacctcccagatttctgagattctctttctcaattttttcaagcacggtgtttttgtctttttctgaatgctcttctccttattataaaaagagtttttttcagaaaataaaaaaatcccaaacactttgtcttcagctgtcctctctctttaatttttttacaccaaaaaaagttttgctgatattacctgctctgaagatgtttttgagtccatttggatcattccaaaatctagctttctaaccactgtctattttgtatgtcctctatctgcttttccaacctcttattatataaatggatctccacttgaatgaataaactacattgtcaatacatcagacttaaggccaagaattaaacaagtcatcttttctccccaaactgtttttttcctgctattggtgttatctacttctgttaaagactctaccttttcttttgactctttctactctcttaatcctaaattcagtatgttgctaaatgtaatcaactctactgtgtctttatcttttgtttctagcctcttctttccatggtggttgtcaaatgctaaagtatgccctatgttaccgcaaaataaaatcatctacccagttctagtttctccgtgatacaaaacattcctcatagcttttacagatcattcttcccaaaccacattttatagaaagcaattctcctgagaaagagccagcagtgtcccctcaacttgctgaattaagtttaaactcctctagctggtgttcatggccagccacaggacaatctgagtctctttacagattcttatcgagtttttgccatttctgtactcaatgcactaatctcattggaaagctctgtagaccctgaaattgccctaaaagttctcctcctatctttgctgcttttaattcttctacctggaaagataaccatttctttcagcccagcatagggaaagccaatccagtattcaaagctcatctacaagcttatttttttttgaaaatcctttgctattttgcatctaagcagaagcgatctcttttctgatccatcaaaacatcttgtttgctcctttttttgtgacaatctatgtcatgttttctattgtttactgatacttgtgtttcatcctctcctattattataaactacttagaagcagaacttatgccttacttatgttttatttcttgcacatagtaaatgttcagtgaacatcattggattgacgtaaagtagctgtaggacaagggcttaacctctgagatgcactttcctcatctgtaaaaccaggaggtctcactctaaagtctcttttagctgtttaatcactccaagggttttttggaattctggactgtaggttagaagggagaattttcacagacattataaactttttaacgaatttctcctcctgaagttattactttaagagcggttgaaaatggagagggctagtgcttaatgacatgacacttgatcgacacttcttacccagtttttgggtatgaagacttctggaacattcttggaataataagattataaagtcctagagctattggagctgaactttgtatctgttttttaattgctgaaatggttaataacaatatagcaatatttattgagtatttactacattgccagacagtgtgtggtaaattattcacaattatcttattatttcttacaacaaagcgtacagtaggtactattatcctcgtttcataaagaaatttcagaagagagtttagtattttataagcatctagtaaattctgtgactacgttccttatatgtagtttgatcttattctcataaagcttgctgaacattgtttttattgcttgccttttccttactgttttttaacttaatcttactaattttaaaatttttacttatatttcatatgaaaaaataatgcaaatttatttactttgaaagcctgtaaattttgacaagtgaaaatttggaccttaattaacctgaagtcatatattgctctacaaaagcattcaaatgtcaatatgtgatccgtggcccactggtaggtcttggtgaggtggaaaatatctcgaactgactggaacttatcaagtctttcagcttctgtcaaacaatggcaggaggccactgatgcttttgcaccaaccacttctaggcaaatttcagttatctatccatctggcaaactcattgaacttctcctaggatgggaacaaaataacattttcctaagtgtccaagtcatgctgttgctaatggcatgtaggtgactaaaactagggagatagctctcagagttgtgttcttcagatcaaaagcaagcacatatcatattctatatttaatacctattgtatgccaaactttaatctaggtactagggatacaataatgaagaaaactctgctttcagagagcatattatttttcctttctttcttctttttgggacagagcctcactctattgccaggttggagagcagtggtgatcttggctcactgcagccttgacctccagggttcaagcaatcctcccacctcagcctccctagtacctgggactacaggcatgcaccaccacacctggctatttttgtattttttgtagagatgaggtttcaccatgttgccctaggttaaaacttctcagatgaagtaatccacctacctcagcctcccaaattgctgagattacaagtgtgggccaccatgcctggctgtaacctcttatcaggaagaggcaaacaacagccaagtcaagattaatttcagatagtgataatgctctaaagagaatagaagagcttgatatcatcagggaagatgctcagcaattatgtaacaggacagccatacctgtttgtatagcctgtgtcccttctgattgatgcttctgctttacagattattaaacggtttttaataccccttctgcatgtgacagtgagtgaccaggggtgtggtcatatcgattgagaagacagatctcactgaggagagacttttaattgacatctggctaacaagaaggaagtgactgagggaaacaggacagctgcctctattcatgtgaagatagtgggacaagttcatgaaaggtctctttggaaagcaaaagctaggcctttctgggcaagagaaagaagatccgactggaacatcttgtgtagaagacagtggaaggagctaaaatcaggtaagtattaaaagtgtacattatggaagaacaattacctgtgcttgtggtcaatattttgctgaagtagtaaggaatgttctgatgtgaatctattgttaatgtatcagcagtcggcatatggggaagtatgcaaaaatgttttaaaaaacattgttctagtcctcttatgaataagttggtgttttttttttaaaatctatgattggacaaagatgtttgggatcaataacaagtagcaatcattctatttgtcacaagtagtattttgatgtgcaaataaaaaggatgcatgtaaatatcacacaaatactgttttcataagtcaatagttggcaatatgcccaatcttgatttaatgttcaataaatagaaaacattgtgaatgtgggtattcatgacgattaaatatctgacttttcagattgctatgcaaagatatgttagaattgaagataagactcaattttttccctcagaactacagtagttgtcaaggggaaattacttctgggagctttacaaatgagggctaagattgatttttaattaaagattcacagcaccaataaaagattaaggtctattggtctcatttcaggcacttttgctctgtaacatatctcagaaatactttcaataagattaaggtttattgctctgattttggtcacttttgctttaagacacatcttagagatacatttaataactcgatgtgatggttaatactgagtgtaaacttgattgacttgaaggatgcaaaatattgatcctgggtgtgtctgcgagggtgttgccaaaggagattaacatttgagtgagtggactgggaatggcagacccacccttaatctgggtgggcaccatctaatcagctaccagtgcagctagaatataaagcaggcagaaaaatgtgaaaagattagactggcctagcctcccagcttacatctttctcccatgctggatgtttcctgcccttgaacatcagactcttaagttcttcagttttgggactcagactggctttccttgcttctcagcttgcagagagccggttgtgagaccttgtgatcatgtgagttaatacttaataaatttccctttatattcttatacctatccctatcctattatttctgtccctctagagaaacctgactaatatacttgaatagtctacacacattattttagtgataacatgatgttaatattgatgacaagacaagaagatttcttaagaagtctaaattagttcatacagctcgatttccaagaatgtgatttttttcagctttcaaatttcttctttgcttgtcagataaataaatgaatgatataatctttgatagattataaaagccatatttaaatgctgtaataaacatgaagaaatacacacaaaaaaacaacaagaaatatacttcctaccatgttcctacatcaccataccattgcttttaaatgtgcttttaaatgtgctgcactaatcagttgagcatcttttagcacacaggacattgtattcaatatgaaatctcccaattatttctaggtctatgtttaatccaaatatcaagaactgtaaggcagaggcatgaaacattaaaactgtttgctagttaagaacttctcatttggtagtaataaagaaggctacagtaaccaaaacagcatggtactggtaccaaaagagagatatagaccaatggaacagaacagagccctcagaaataatgccacatatctacaactgactgatctttgacaaacctgacaaaaacaagaaatggggaaaggattccctatttaataaatggtgctgggaaaactggctagccatatgtagaaagctgaaactggatcccttccttacaccttatacaaaaattaattcaagatggattaaagacttacatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattcaactaaagagcttctgcacagcaaaagaaactaccatcagagtgaacaggcagcctacagaatgggagaaaatttttgcaatctactcatctgacaaagggctaatatccagaatctacaatgaactccaacaaatttacaagaaaaaaacaaacaaccctatcaacaagtgggcgaaggatatgaacagacacttctcaaaagaagacatttatgcagccaagagacacatgaaaaaatgctcatcatcactggccatcagagaaatgcaaatcaaaaccacaatgagataccatctcacaccagttagaacggcgatcattaaaaagtcaggaaacaacaggtgctggagaggatgtgaagaaataggaacacttttacactgttggtgggactgtaaactagttcaaccattgtggaagtcagtgtgacgattcctcagggatctagaactagaaataccatttgacccagccatccaattactgggtatatacccaaaggattataaatcatgctgctataaagacacatgcacacgtatgtttattgcggcactattcacaatatcgaagacttggaaccaacccaaatgtccaacaacgatagactggattaagaaaatgtggcacatatacacaccatggaatactatgcagccatacaaaatgatgagttcatgtcctttgtagggacatggatgaagctggaaaccatcattctcagcaaactatcgcaaggacaaaaaaccaaacactgcaggttctcactcatacgtgggaactgaacaagagaacacttggacacaggaaggggaacatcacacaccagggcctgttgtggggtggggggaggggagagggataacattaggagatatatctaatgtaaatgactatttaatgggtgcagcacatcaacatggcacatgtatacatatgtaacaaacctgcacgttgtgtacatgtaccctaaaacttaaagtataataaaaaaaaagagtaaatgaagtagtcagctggatatgggacctgtccataactcacaatatttatcatcagtcctctgataaataagttaatgaaaattttcaaactctctcactgatataaaattttattatttaaaaacttgtggtaatactgtttctcaatttatttaaaatgggtatcccatttatgcagtaaagacacattaatttgtccacaaatcagaaactctgccctataaaatacgatgtttttgctgcaaatgagatttttctgagtgcacagagaagactgacttaaagtttagaaatgatagttaattggaaaagagtttattaacttaaaaataatgagttaagagtccattaatttttaagtcttttctataattagatttagatttatggtgaagcaattattattgcatcaaatcgatggtttgagccttactattgtcaactgaatgaatgtttttaaaagtaaacttttttatcttttttaatattaattgagttttcacgtgtactctgcaggttgatgctgccatacaaaagcactgctttctgcatatagacactattacatgaagattagaagttaatatttgaatacttccaaaaatataaaatgcagttaaagaaaaaaaatgatcaacactccaaggaagcaatcagtgaaatctgtcatgtaaggcattctatagggcaaatgaccttgttttttcaataaatcaatgatattaaatgaataaataaataaatagatagataaagaaggctgctaaaaaacaaagaagacttaaaagaattcatgatcaaatgcaatgtgtagaccttatttagatcctggttcaaagaaaacaactataataatgattgttgacagaatcaagaacagttgggcatataatgacgatattaaaaaattagtactacttttatttggtatgaaaatagtagcatgatggttatgttaaaaatttgcttttattttctaaagtagaatgtagatgtattcacaggtaaaatgacaagatatatgggctttattttaaaatctccaggaaaagaattagaggagagtgagtaagcctagacatgaaaaatattgatagatgttgcacctgagtgagtggtacatgagcttttgttatattattatcttaataggcttgggctagtataacaaaattccatagattaggtggcttatacgcaacagacattatcgttcacaattatgaagtctgggaactccaagatcaagcccttcaccttgtttcttttgtacacattattttttttttgagattcactcacatatttatctgtaattcaatcatttttatagttatataacgtaaattttgttgctatagacattcttgtgcatgtgacttggaacatacaggcccaattttctgaaggttttataccctataatacaatagctacattattgaatatgctgttctttaacgtagacgcttagttcacttttatttgtctttctacttttaaaacatatgcattaaaacattgtcttagcttcagcccacttattttgtaaatgcaacttttattatttttgagttcaaaatgtttctaatttttattactattcattctttgtcctgattttgaaaagcatttctttaaaaaattgaaatctaacacattaacacatgtacacaaaaaagtgcacaaatcataagtattatagcaaaaatgaagagccttataaattgatcactttgaagttcctctcatctcccttccaaggccaagattagggtagggcagaaaggtgcgtaaggcattaattttaagaacacagttactcacagggttgtgcatgtgccaaactggcacttgcagggacttgtatgaatgtgagagtgagtatctccttacatcttgcctcctggctatcgcactctcctgaccccagttcaggatatggaagccataagcaagacgtagatgaatgagcattgctgtgttccaataaagctttacttgcaaaaccaagcagtgggccagatttttgactgcagactctagatcgctgatgtctgacctgaattcctttaccgacctacataacagtttattaattctctcttcagcttcatctaatctgttgtgaatcccattggtttaaatagtatatttttaatttctagatgtctatttgctatttttttcaaatctgttgtcattttttttacaatttctattttctaaagtttttttaaacttgtctttaatttctttaactgtagtggttaaaatcagcataatggttttatcatctgtgactgatgattccagtatctgaaatcgttgcagctctgtgtttgacatttttgctcatgatacctgtgttcttgtgtgcttgtttttcctttatcatatgatcctcaatatccttgcaatttttttttcttggggaaataacttaggataaagatatggtcattaacagccatggttctcaaagtgtggtccctggaccagcaacatcagcatcacctgagaatttgttagaaatataaattcttaggactcatcctagacaaaataattagaaagtctggggttgaggtccagcaatctgttttaataaacgctccacatgagtctgatttatgttccagtttgagaattgctgctttaaagaagatgttcaaagtttattaagtgtctagagtatctgggacgtggttaaattcacgtcttgagttttttgggcctctcagatgatgttaatgtgggtggaaaatcttgacttgtatggcaaacttgtcttgagggtgcagccactatggcctcagattaatgtggggagaatgtcctatcagatgcctgtatcttgagtggactctgaaatttgattgctcctcctctcatttcatatgccccctctaaccgaagttcgaagttcaaagagtgacaagaacttcaaataaaaagagcttttgtgccactttttcctctgccttcaaacttgcccttcagttctggtaattcagttcttcccttctgactagtaataccttatttttttagcttcttaatgtctttgaggtgattttttaaattttatccaacaatttcagtttgctttcaaagagttagttccaatttcctagcttgccattatagaagatgatctcatgcaggcatttctaggattagtttgttttcttctaaaacacgatagaaaacaaaaaaatttaccttagtggggacatggcactgatttgaaacattcttaaaatgcttaccttctgacttacgcctcacctaagtacagatttactttccaataaagcctgttggccttgttgaaactgctctctgtggatgttgaaagttattttgcttcacacatttatcatacgtgtttgaatgtgatgcagcaattgcctgagacttaaaattaatctttgagagttcattcatatacttattataataaatattcatattggcagaaagtggatcattctgaggtggaatgttgctttaaggaagtgaatttattgactgttggatgaaaataacatatttatgcaaaacgattctgtaaagcaacatatgctatttgctttaagagatgtattcacacaagagtgtagacagagaaataagttaagttaatttaagattccaaaccttctcaccaggacttttttaatgataatgtgaaaatattgttttttgcatggacagatattgaaattgcataaagccaccacaatctgcagctgacctgatggattctggtgaggtgcatgtagattctagtgaaaggaaaccaaatataattctctggagaaatttggattaaaatgaaatattctctgcttctctgtgttttttaaaagactgttttgtactttgaacatactgcattcagacaactaaaataaatgcaaaggagcctggaaaactcactagcagttacactagaagcagaatgtggcaattatactacaggaggagagaatttaaaatattacctcagaaaatgtaccaggatattgtgattagcaatcaaactgtgacttctttttttaatctaattatagtctgcatctacaagatattgttttattagttattacagtgcaggtaagcatgggcaaaagactgatcttgtctgcaacatatctgtggtaatttctataaaatgaatctgagagtgaatttgtttataacctcaggtgatatgatttccaggtcttccaaaattgtttcctcagttttttcttaattccatagtcagatgtggatatctgtgatatgagttgtaagacaactcaagagcctaaaattcccataagtttctactggtttagtgagcaacatatctgagagaaattggctctcttaaaaagctcaaaaacgtgtatgctcaactacaacagcattacaaaattctttatattagaacatattttaagacctcaacatgtcattgggccccttgagatatttatgtgctcttgtgctattcactgaaaatatacaagttgatctataggataaattgttcaaaagcttgcagctacatttactgcttaatatcaccccacagaactgcctttttttcatttcttatatcccaaagtaaatgtgggtaaagtagaaaacagggaataaaatcattttttccctgttgaatctacgtacctagactgtttttggctagttgcttccttatctccttctgctttgaatgtcttaccttgttgttcccttcaaaaatcacctactatgtatctaatactatgcaaaaaatctaaagaccctcattcttccttcaaggagctcaatctaatagctacttagaagataaatgagtatgtagtattgcttcacaatagaaatatgggcaatgatttgtaggaatttatataattggagtgaggattcatactatacaagggtgcaatgtttaatgtgaagaatattgttttcttataaatacaggagcccgtcaataggatttataatgtatatataatgaaattaaggtaaaagtagacatagaatcacacagcagattaactggggacctggaaaaaaatttgatgagcaatacatcaatataactcccagtctaccaaccaatgttcccaggtgagccctgaagctcttggtatgatggggcctgtggataagcagctaattgagcaaggccaaatcttccctcttcttgtatcatgatatctgcctgtgtttgtcccagtactggccatcacagaatgaaagtatggtgaacatgaagtgatatttttaatagaattataataacaattgtcataacccaatatgttataaaggtatttaaaaacctagatattggaaggcactttcagaatatgagtactgaaaacctccttaacaattattccaccattcttaaacttatacctttgtttacatgagagccttgaagagcaaaaatggtcctgagaaggctggaaaataatattttgtgcaaacttgagttatttgtcaatgacttttataagcaattatatgaaatcagccctgtttttactatatgtctaaatttcagttgcacatttatgtatgagttttgtttcgttgttggaataaatctgctatgttatttaacttttcaaagaaaaatttgaagctgaaatgtatgtaagggaagattagagtttgaatctacaggcttattatgcctaactgaatgtatttaggcatttgtactctgtgggcactatttttgaggaatatacttgtatgcctagaaaatctgaagcaagtgtgtgaaaaattaacagtcacaaaaatgtgagtaactcagttgaaaattatttaaaaatcaatagctttcctatctgccagcaataaccccttagaaaatgtattaaaaaagattcttagtaataaacatagaaaatagtttaaacaacctataaataccttaacaagaaatgtacaggacttgtatgaggaaagctatatgctatcactaagatacataaaagaaatttagtaaggagaagtattttttcctaaaaggcaaactgaatataataaaaattttattccttctaaaactaagtataaatataaatacaatacaattgcaataaaaattccagctgaactactccaaaatcggctgctagaaataataggtaaaaatagctaagacatttttaaaagaagaaacatgatatgagatttgcattaacagataataaaataccttactggtaatattcaatcaaactatatgtgggtaaaattcattaaaggtaaagacaattttctaataataatagattattcagtgtactctgttggaatgactggttgtatataagaaaaaataaaattgaaatggaatgcaaaaatgacttcacattagtttctgatagaggcaattcactttattaagaaaataaggagcagtcctgtcaataagatgtcagtctccacttctgaaaagacaactttaagattcatttctagttttccttattctggtgcagtagtccttgagagaaaccatctcatcaccagaggcagatgtgtagtaccttaacagctctgaaagcttcttctgattttgagagtcttcatgtattccaagctttatgttttcagagaactgctcatagaacttcttgtagttctctttatcttctgccagttcagtaaagagttctaagcattttttgaccaaattcttcctgataactttcaaaattttgctttgttgtaacatcttatgggaaatatttagagggagatcctccgagtctaccagcactctaatgaagttcaggtattcagggattagctcctcacagttatccgtgatgaaaactctgcatacatacaatttgatattgttctttttctttctgttttcaaacaggtcaaaaggagcacatcatgggaaaatagaagggctctgtattccaactgtccttcaactgaaaaatgcttcactgacaagtgatcttcccagtcattagtcaagctcttgtagaattctctgtactcctcattagtaatatcatctggatttctggtccagatgggctttgttttgttgagttcttcttgatcaatgtacttttcctaatcttcttcttcttctgcttgtcaccatccttcttttcttcttcttcctcagcagaaccaacatcttcaatttcaggtttgtcttcggattctttctctttttttgatgtttagaaaattatttgttacatcttgtaggacctactttttgaacttttcatcccctgtagttgccaattctgcatgtactagtcctctagaaataggttaaactgaagcaacttgatggaaggaattctccacagggcttgttttccaaagaaaagtattatttggaggagaaaagttataagcctacctaagcatatcataaagctgttcaaaaataactcagacccagtcttgtggatggaaatgtagtgcttgagtcacattctgcttaaagttgtaacagatacagatgagttaaaagaaaaaaaaatccatttctgatatagtgaccttggagaagatgaaatgcctcagtgtgtttgttattaacaaaaataacaaagatgaacaaggacccaaacttctaatagggcattgggcttgtcaaaaagcatggcctgaatttcagcctccacactcttctgtcccccaagaccctttttagccagggaaatacgtgtagtgcatgtgagccctgagaggagtgtagcatataagcaaactattattaataggatgttggcatacctaagaaatattgcaggtttggttctaaaccactacagtaaagtgaccattgcattaaagcaagtcacacacacatttttttttttgttttcccagtgcatataaaagttatgtcatactatattgtagtttattaagacataatgctattatgtctaaaaaacaatgtacataccttaattaaaaatatatttttcctaaagaatgctaacaattgtctgagccttcagggagtcataatctttttgctggtggaggatcttgccttgatgttgatggctgcttacaaatctggttggtgactgctgaagattggggtggctgtggcaatttcttaaaataagacaacaatgaagcttgacacattgactcctccttttgcaaaagatttttctgtagcatgcagtgctctttgatgcattttatgcacggtaaaacctctctcaaaattggagtcagttctctcaaaacttgctgttgctttgtcaactaaatttatgtaatattctaaacctttggtgtcattttaatgatattcacggcatcttcaccaaaagtggattccatctcaaaaaaccactttctttgctcatccataagaagcagctcctcatctattcacgttcaatcatgagattgcaatgattcagtcacatcctcagtctctcctaattctagttctcttgatatttccatcacatctgcagttacttcttctactaaagtcttgaacctgtcaaggtcatcaatgagggttggaatcaatttcttcagttaatatttatgttttgacctgctcctatgaatctcaaatattctttatggcatctagaatcgtaaatcctttccagaagattttcaatttactttacccaggtccatcagaggaatcactatctttgggagcaacagccatatgaattgtatttattatataataagacttgaaactcaaaatgatgccttgatccatgggctacagaatagatgttgtgttagtaggcataaaaacaacattcacctacttgtacatcttcatcagagctcttggtgaccaggtgcattatcaatgaacagtaatattttgaagggaatcaaatttttccttctgagtagtagatctcaacaatgggtataaaatattcagtgaaccattctgttaatagatgtgctatcatccaggctttattgttcaatttatagagcacaggcagagtagatttagtataatttttaaccttaggatctttgaaatagaaaggggaattgtttcaccttaaagttaccaattgcatcagcctccaacgaaagagtcagactattctttgaagctttgaagccaggcattgactcctcctctctagctatgaaagtcctcggtggtatctttattttttttttaacttttattttaagttcagggatacatgtgcaggtttgttatataggtaaacttgtgtcatgaaagtttgtggtacagattatttcatcacccaagtattgagctagtacctatcagttatttttctggatcctctgcctcctcccaccctccatgctcaggtaggtccaagtgtttgttgttccactctatgtgtccatgtgttctcatcatttagctcccacttataagtgagaacaggcagtatttgattttctgatgctacattagtatgctaaggataatggcctctagctccatccatattcctgtaaagacatgatcttgttcttttttatggctgcatagtattccatggagtaccacattctttcaataaagggtatttcatctatattgaaaatctgttgtttagtgtggccaccttcatcaatgatcttagctagatcttctggatcacttgctgcagcttctctatcagcacttggtgctttaccttacacttttttgttatggagtcagcttcttttcttaaatctcatgcactgatctctgctaactctcaacttttccttttcagcttcttcacctctctcggccttcatagaatggaatagagttagggccttactctggattaggttttggcttaagggaatactgctgttgttttgatcttttatccagactactaaaactttctccaactcagcaaaaaggctatttcactttcttatcatttctgtattcacttcagtagcacttttaattttcttcaagaacttttcctttacattcataacttggctaagtatttgctgcaagagcttagctttcggcctattttgcttttgaaatatcttcctcatttaacttaatcatttctagcttttgatttcaagtgagagatctgtaactcttccttttatttgaaaacctagaagccactgtagggttattaactggcctgcttacgatattgttgtatctcagggaatagggaggatcaaggagaaagaaagagatggggaaacgggcagttggtagagcagtcagaacacacacaacatttatcgattagttcgctgtcttatatgagtgtcgttcgtagtgcaccaaaacagttatgttagtaacatcacagatcaccattctagataaaacataatgaaaaagtttgaaatattgtgagaattaccaaaatgtgactcagaaacacaaaatgagcacatgctgttggaaaagtggtgccaataatcttgcttgatacaggattgccacaaaactctaatatgtaaaaaatatagtatctgcaaagtgcaataaatcaaagtgcaataaaataaggtatgactgcatgtacacatataaaataactaatcaaaattctttttaaaagtttagctaatgtgataggctaaaaaacagcatgtttttggaattataatttacatttcttgtacaagcaatatttagcatttatctctcaatgtttattggcagtttgtacttctctgatttaactatttatgtccttagaactttatttgttcagttttgtcatttactacatgtttaaaatttttatactggggacattttatactcagagaaaaggcacctttttttaagtctacaaagactaaaaaacagtcatgagattggtttatttttggagattttctctataattaaacaataaaagtcaaggctagagatgttaattaagaataagtttgcaatgtgccttaaatcccaagcagagtaaattgtacttttatcacaggggcaatagagagcaattgaaaattttgagtaggaatgtagtgagatgaacacagtgtttattattatttatttgataaaggaaaaatatgtagaaaaggtttataactatcctctgccatttgttaccatatggtgacctgctgttttctcccaaattgctctattacatttatgtttccctggtgttaaaaagacttccgggtatagtaaagagtaatggcctaacaccaagaaaatggaaatttgagctccagattataaattttgctgcaggtaagggcatgaaaatgagaaacaatttttaaaaagtgatgagatgaggtgcttgaataatttaaaatgagatgggtcaaatcctgctacaaataaagtttgcagaataattgggatgagcagctgaaattagatttttcaaaatttttctatgtctgtaatttgtgattaaactgccattaaaaaagaactatatactttcttttaaaaaataatataaatttgaaataaccataaatagcttttagtctctgctcttgatttttttgatccaaaaataaatagagcataaaataaagcttttataggctattgtccactttgttttttctacttgcatcctgaaagttggaggtgtaagacatttcaggtcacttcattagccaactcttccaggagggtactgtctgggctgctgcaatttctggtctcatttctcagatcatgactgcctatgtgtattcctgacagtctagccacctctgggacagtaactgtaaatcgccaaagacacaccattaaggggtatgtagtaccagcttgagaaaggggaacacattgaaaaacgatgaaagaaataaatccattaatgcccagaaaatttttggagaaagtagttcatttttttttctcttcctcaagtacaaagggtttcaaagtttggaggacgggactatttggaatagaaacgtacaaactctaaaaccaaggatgctaaggaatcatgaccttagtcttggggaaaggttaccttctggagttttggatgatggaggctttcttgactttgagataggtgtgaagaagctttgtgtaagaaacacttttattactgatgcaaaaaatgtggggaactcactgctttagacttgctctagaaggaaagttaaggggcctatgatctcatttgaattcttttggtctggtaatgggcatagaaaaagcatttggattctacgggcagcttcttggtgatccctgatgaaaactagtggctggctgtgtttttggcccttggggacagcagacagtggaaagagggaaacggactcttatatgttttaaaaaatttgtcttttctggattcaaatgccttgcttcatgaggtaatacactattactaagaaattactcagacaataatgaacacatttaaattatcattattattaaatatgacacagcaaactttctaaaggctccagaaatactttcttcttgagtaatatttatttctagaccaaaaatatgattgagtactcataaattcccaagtgtgtcaaagtaaaaacaaaactgctcaaacaagataacatgactccagcagaaagcaaattaaaaatgcatttattgagctttgcttatatgactacatttaaaaaatttactgctgacaataattctgtcagtaaaggactaatattctcattttataaataaaaaccaggagactcgcagaggtcaagtggcatctaggatactgttggatgtgggatttcaacttctgacaatgatccagtggtgtttccactgtactagaaacttatgtgtggaaatacacaaagaatctacaatatagtccactgattttcatctcaaacctaaattttggtggggtcagaagaatcaaaagatcctttaatgctagttcatagctgggtgagcaactccattttcatatatttaactttaaatttgtaacattttgtcaaaatattttaatttttatatctaaaaataatatttgtacttgtggtcattaattgaacatcagtaattatatttcaaagttgagttttaactaagaattttgatttgtttactttgggtagatggcatacttgtatatgaattgcatttttttcaatcaccatctaacatgataattttcagtagggccaatgatgctcactttccctgtaacaacactctaaggcagatttgattattataatttcacaaaataagaaatgaagcacaaaatagttaaatgactagattcatgctactagtgacacagttcaacctgaaagatggttttatcgtaaatcagatattacccacctggatgtcttcaagcttatcctgaattcccaggctacattttgctttaataactaaacagaatggcttgaatcctatctcatctattatgaggaagctatattcttctcaaataatccaggtattctttgggtgtttatgattctatggttacatcttgctttgaactcctgatgactccaaattcttatctcaattgccagcttctgtctagcacaggcattattgaatatgaggcattagtgtctcactgtgatgtgttgtgatgaactatactgggtgtagttctccaccatacccatcacagagaatatactactgggcaccttttgcttcagaggcatggcatctatcttaaacttctctgtcctgagaaccttttcctacatccaacctttccttttctctctgtcccaaaacctgtctcccacacggagaaaataaataattactcttcttattcatcatgtaaataaattctttgagtggtctcctatttagtctatatatacaattatttattttaagtaaaggtattagattgttttttcctaaacctacaggaggttctccccttatgagggattctgcctacacagtagacatagattcaaattttatctttttgtcatgttgatattgtatttgggcagctagagattccctgatggtcttctggcttgattacactcttcgtggcttacaagttttgtttcccaaccaatgtttatcctttttgtccttaataacagaactgtgattttgtggaggggtagagggtgaagggctagtaatacactctgttgaaatattgttctacttgtgtgtctttagctggtggtaggcatgtggaatactgctggtcaaaatgctctcagatccaagcatagggacctctgctctgggttccacatttcagagagccccatgtatcacaaacagataaaaaataaatgtgttgaagagcacaagtgcctctgtcactcaggatctgtcattgagcatggacacatcctaggcacctgttgtcatgaccgataactcttcaggcctcaggaagtgtggtatccttgtccacatctcatagcatctgtagacaaaataaaaaccaattgtactcaaatactgggaagtattgtgggttatgctgctgctgactttggagatgaactttgtggtgaagccagggagttagaacagcaggagtgcttagataagaaaaaaaatgaatttcagttaaattgataaatccttctcatatggcataagtgaaatcaattcttccatgataaagttttgttgagtttctactgtcttgcttcttattgttcctcttgttgtgattccagaagtaattactaattagttcagtatttacaagagttgcagttttatgtattaaagaatggacactaaatttatagttgaatatctagatctagtagtaatgtgtgaagcataataacaattaatagcaccactgtgttaaaattccttttgtcagtaactttcatgataacaaatttgcaaaatgtttgcatttaaaaaatttgaacgattagcagcatcccacacaaataaaccctcctttcttcttgaaacatttatttttctcttttggatttcctctcagttttcttcctatctcatttattttcagtgttatttttcttctattactaatttctgaattttggctactgttagagttattttatgttatatatataatctgattctgttgattttatctagtctcattactttaagaataattgagataatacagagatcagattgtaaaatcaggcttaaaagaatcaaataccttactaactatcaaaatttactaataatttcatagatacatgtcattccagtttagtttgccctaagaaatccaagaatgaatatattgtgataaaagcattttttagataagcactttcttactagcaactttgtacatttatcagaagtgcaattgtacatgtgtacaaggagatttccccggtaatgccttctttcttttcccaaggggtgtgctctgatgaaaggaaagaatggattgcaaacctgctgctaacccctctctcccaaactaatgtttgtatgtttatattgatgtcggtatattgatgttaattcctcccacattaaatttagctctttatggtcaatgccatatttatttggtctaggatatggtaggcactatcctaggtgctggattgtgaaagtagattaagacacagtctaaatcctcatttcttcctcatgaagatggtgtctgaaagatggcagtagaaaacaaggcattaagccacaatcctaaatatgcatatttaattaacactggtggtgctttgggttgaggggcatagaagccactcaatctgtggcacaaaattactttgtataaaagaccaaatggatttacactttatatttatccttgactcatatttaaattaggtaaatgattttgcagtctgtatttttgtgactgatttatctcattattttaaagttaataaacttgaatgtttcttcatagttaattatttcatagttcattgcatctagaaccaggtggtacaaaagaaattcaatagatttatcataaagtccagagtctaatctagtttagatatgggagagactcaaggcacgattcatcctaaagcaaatccctccttagctacgagcctgtgaaatcaaacaagaatctacttccaaaaactaattgtggcacagccataggatagacattcgtatgccaaatgaaagaaataggcaagaacaaaggagtaactggtcccaaatgtgtccaaaagccagcaggacaaatgacattaaatcttaagacttcagaataatcttttactctatgccctgccctctggccatactagggcaggggttgtgccccacaaagcttcaggaagccctgccctcaaggctttggtgggctcatttcatgcatcagctctcatgggttggagtctcatgcatgcagctctcacagggtggtgctgcatgtgagtagctctatggttctgggttttcaagggcagcatcacccctgtgactccactaggcattgccctaatggagattctcttaggtagttttcccctgtgcagatttcttcctgggctctcaggctatcagatataaccttcaaaatataggtagaggtaccatgccttcacagctcatgaactctatgcacttgtaaaattagcaccatgtggataccaccaaatcttacttcttgtgacctctagtgcagtggactgagttacacctggacctgcttgatacatgactggggcagggagctgaggggtcctgtgctgggatgcaaggaataaagacttgaagtggccctgggcaacaagccttccagtactaatttttgttatagtgcattttgtgctgctataacataataccacagactgggtaacttataataaaaagaaatttattggcccacagttatggaagctggggtgctggtatctggcaagagccttcttgctgtgtcataaaaggcagaagagcaaatagggagggggaaagagaaagaaaaagggagagagagagtaaaaagaaaccaaacttccccttttataagaatctcactctgtgacaatggcattaatccattcataagaacagccctgatggcctaaatacctcttattaggccacacctgccaaaactgttgcattggggattaagtttccaacacatgttttttggtgggacccatttaaaccatagcaatcatgttttcattttctttattttataatactttgacttagtggaaccatgcagacttaagaagaaaatgctccttccagggctaggtaatttctagagatagcaaataacttccctgcaagcccacctttcatatacaaaccaagcaattcaaagtccacgtttccaaactcttttttttttttgtcaaactttcacacatcaatagtccccccaccctaaatcaccccaggaccaggtattgggcaacaagagaacatttctgcagctcacagcccacaaaaagtcttcaaactatccaatcttaaccttactcaatatctctaccctgctttgcctgctcctcatgaaagctccactaaaggctctggtctatgttccactgatacttgttctgtatcctgactgaccttgctagctgcccatgtggccctgtgtaatgtagtgtgccctcttctcttgggacctgtgagtaatgaaacttccttcaatttaaactctctatgttctcactcaatcacctttagaaataaacctcaagcataatcacaacagactctcacacatatccctctattaaaacaatttttaaaagataactagacatcatcttgtaagtgtttccaataaaaaatgttcagctctcatatatcattgtgtttcttcaaaggccactttagaaatatggattctggaccacagcctcacatactctcttgatcttcctctaggccacttgtacccatcccctttcctggttcttattgagcaccttgacctctaaactttaaaatttgaaaatttgaagttttcagcacttggctttcttatcttttccacttacactctttctagttgatatttatactttcaaggctttaaagttcatctctacactgataaatttatatctccaggtcagatccctctcctgaacgtcaggcttgtatatcaaatactgtagtcagcatcactttgtagtctaaaagacatttcaaagtaatatgtcccaaagttagcttcttagaattaatcatgtaattatcttagattattttcccctgcctcactttcacaccatccattagtgaattctggctcttcttaacagaatagctagagtgatcactttaatactgaaatcatgtcactcctcaccctcggatatttccatgatttcccattatactcagggcaaaaacacagttctctgccataattttgtaaggcctcccaggactgttctgatcatattcttccagtttcctctcttcctcctatccattgctctggccttttcgcagttccttgaaacatgccacgcactttcctactttagcaccttgcttttgcattgcctagaaaactcctctcctgtacccatgaggctcactctcttctagccttcagacctctattttaatgtcaccagtgagtaaggtctttcctggccactgtatatataagaacatgccaccctgaccccaaaagtccctgttcaacttgtttcatatttgtacatttcattttgtttcattttttacactcaaataaatgaaaattatgtatttatgaatgcacatgcatttcatttattatacttaaataaataaaaataatttcatttattatacttttttaaccttttaatttgttgagtatatgtctttcctcctatagatcaatcttttctgtctaaatcataagctctgtgaagtcaggacattttgttaggtttgttttcattatccttctacctaaggcagtgcctgatacatggttagtgatatggtttggctctgtgttctcacccaaatctcatcttgaattgtatccccacatgttgatggagggacctgatgggaggtagttggatcatgcatgcggttttccctttgaggttctcatgatagtgagggagttctcatgaaatatgatggtttaaaagtggcagtttcccctgcctctctctctttatctcctaagagccatgtaagacctgccttgcttcccctccctctttggccataattgtaagttttctggggcctcccaagccataccaaactgtgattaaattagacttctttttctttataaattaatgagtctcaggtagtatctttatagcagtgtgagaatggactagtacagttggcattcacaatgcatgtttgctgaataaacaaatgcattaatttttaatttagtgaaatgctatcacataacaattttgtgagtgaaagatggtgaaaaaataaattatttgaaatctgacagtacaactaatttagctttggtgagaggaatttcatccagctatatttttttctgtctgaatctagatttctgatttacttcatatccttgtttcctatggtggtctgattgtaagtaaaaaatcatattttagaggttatgaataataaaatgtaaatatgagtcttgcatattttaaatacatttatttttcattttttaatgtaaataaaacacctgtagatttcattattgatcttaaatgcaagggtgtcttgcaaaggttaaaaaaagcttacgattccagtatattaaatatctaaagacaacagttgagctcaaataccatagaatagctttcaactcaaagtatgtaacttgaaatatattactgtgctaacttcaatgtaaaataaattatttcttacttctaaaatttaaaaaaaataagttttgaatcaaaattatggttagatttttttagactaagcagttgaattgcattcaacatgactatttttaattatatgaccaccttttacaattagctttggatgtatatgcaagctagggaacagattactgccttgcagcccaccttcccagtggatctgagtagcttaatatgttacacattttatcctctcaggaaaacgtttcttactttcaagctataattaacttattctctaacgattgtttactgcagaaaacaagctaatccttccaaatcctcacatccactggtgaggagagagaaagatgaattttgaatttaacagtgagttacagcattaacttcaaaattgcattttactgttttccattcataattcaattattgcagctgtacttattttgccacaggtttatttgtttttcaagagaatagaaagagtttctatgcccaaggatttgatgaaagtgagaagctcattatatggccaattattgttcataacctgacagctttgcaacagtctccaaaaatctgtcattttctctccacagacaagttctgttcaacaagcccctatagcacaggttaaactactcgattattcttaaaaagtgtttgacctcattccttgtaccctgcagggaaaaaaatttaacatttaaccaacagtgaggaatctttgctgagggtgaaaaatattcttttttccctagctaggtgtctgctcagttgaaacatggttgaaatattctagtttagatttaatagctatgagcaagttttgattttttttcttgatcctgtgctttcctgtgcttcataaattccttgtaaaggctattttgatattttctctgaagactaaaaatgtactcagtgtagtctaatcagaaaaatatcctcaactacaattacttcagtggtttactgtttttccaatatgccaaagacagtatatatacacaggactatatgaaaatgtatattacggataaaaaaataaaattatctaccatatacaaaccacatgcacccaccaccttggccaagaagcaaaactttaccctttaaattttatccaagcaggcttcttgtatctctcttgctcttcccagaggtaatcacttcttgaaatttgtagcaggtatttctttgctttctattatagtctttgccatctttatgaatccctatctaattctaatcaatacattatttaactctgtatatttcgggcactgtatagaagaaatcatagcatatttattcttctataacttgcttttttgaccactattcttttaggtcaaccatgttactacttacggctactcttcaaatttattcatggctgcatagaattccattgaatacatggactatacatcattaatccacaacaattttcatggctttttgtgtttccagtttttgctattctgactgatgctgttacagaaatgcccctaatgtctcctgtacatgtgcaacattttcactggggacttcttcctaggacaggaactgctgaatagtaaagtgtatacatgcccacttataccatagagtataaattattttcaaagtcgtttatctacacactcatcagcatatgaaagttctagtagctccacataatattatctgaaattttttacagtcagtataaaatgatagcttattgatgcttaaattgcatttttacttcaattctacttaaatgtattctcatatacatatattatttcttctgtgaaattccttttaatgtcttttgttcacttttagacattttaaatatataatcttctatggttgtcatgatttttatctgcttgctcttagagagacgtgttaaaatcttttattgtgactttggatctgtatgtttctgtggttcttccaatctttgttttacctattgagagacattttagtatacccagacttcatatcattttacttcacgatgaattatcagcattatgcagagaccttaaatatttacaataatgtttttacattatgtagcatacttgtttcttcttggaaaccaattttaattagtcatcattgtttgacattattatagctatacttgtcttctttgattaatatttgccccatatgtatatctgcacatcaaatctttactttcaactcttatcaacctatgctttttatgtgtctctaaaacacagtaaaacccaatttcatttatattttttaatcttacctgaaaatgtttttaatgcttagtccatttacttttaatgattaaaataatttgatttattcttgtctacttagtttataactgttttcttccagtttttaccagtgttttttctcttattttcttcattatttgaaattaatgaggttttttctcattccattttgaaatttgtctgtactttgcctacattctgtaaacatatttctgctaaatatgggattcttgactgattgatagcttttttattgttggtggtgtctcaaagaagtcagctgttggttccttgtcactcttttgaaagtaatattttctctctggatgcttttaggatcttttgttcatggcttttctatactttctctatgatatagctgcatgagaattttatttattctgatttggatttcttgggcttattaaatatgttaattgtattcctacaccaattctaaaatgttcccagctgctccttttaaatgtattgcctctgcaacctttactgtattctcacattctgagagttttgaatgggaacatattaaactcttttattctacctttcataattcttaatttcattgttccatggttactttgttgttctctatatgcataatcatttctttggttccatatttcaattaataattttctatttacgtggctctttaacagtgttaagtactttaatttcaattacacatttctatttctagaacagattttattttattttttcaaatttacttgctatttacttatttttcaaaactctcttttatgtcttgaaacataatgaacattcttattttatattatgtatctgatgattctggtatctgatgattctcatatctgatgtttttgtgagtctagatttgctcattgtcacttctgctggctttggctggcattgcagtgtccttccatatttgatttttgggggcagtaagggatgtagtttctttggaacttgatctgtaaaaattatttgaaaactgttgcaaaggtgagttcatccagaaagcatatgctctaccaagccagaaatactaggaaaatactcttaagttaaccttttgattgcaactcagacaatgtgaattagtttgcaagcccatgtgtagaaaaacttaaggtttcaaacttttgagagaaattttttttctcctctattgagcataagcttcaaggctgacagtttaccatgtagaccttttgggacagggatttaataatagatgtatcagtagatagatagataggtaatagatagatagatagatagatagatagatagatagatagatagataatttgttataggaactggctcacgtgattatggaggctgagaagtcccaccaactatctgctatctggaaaaccaggaaagtagtgcaattcagtagagtcctagggtctgaggaccacaggtgtgtgtgtgtgtcagagaggtggagatggacactggtgttaagccaaaggcccaagaaccaggaactctgatatctgagggcaggagacgaatttctcagctcaaggacagggagagagaattcgtccttcctggccttttgttgtattcaggtctgccatcaacagattggatgacaccagcccacaatggtgagagcagagcttctttactgggtccacttatttaaatgctagtctgttacagaaacaccttcacagacacccaggaataatggtttaccagttatatgggcattccttaacctattatttttctgtctcagggccctgggaggtcagaaaactcatgctcaagtttgctgagttttggaaaatgcccacaagctcaaggtcatctcaggtattccattttcctctctagatctttgccttcactcattccctgtcttgactattcctcactgtattgccatctcatgcatacagtcataatgctgtacatatttttatctgtacattttgttatttttatgaggaaattcagtttgtttgtttgttttttgagacagagtcttgctctgttgccaggctggaattcaatggcacgatcttggctcactgcaacctctgcctcccgggttcaagtgattcccctgcctcagcctcccgagtagctgggattacaagcacatgccaccatacccagctaattttttgtatttttagtagagacagggtttcaccatgttggccagggtggtctcgatctcctgacctccttccgcccaccttggactcctgggattacaggcatgagccattgtgcccggccggaaattaagttttatattgctagaaatgaaacttctttagtgattaattttaaatattatacttatatttaatctgtttattacttaggatatcgtaatatagctaatgcatgggcttttaagagtttgccagtaaacccaaatgactgaatctcaagtcttgaagttagtcttgattggtattaataatattaaaagtgaaagaaagtaaaaagaaaactactgttttctgaatcagaaactgtgtaccttcttttgaaggttgtgtgattttccaataattaaaactgatgtaattacttttatatggataactaaggaattgacccatgagatatgtgtgatacatgtaagtaaaattctaagaaggtaataagaatgggataaaaaaatgtaacagtggcatgcccaaacaaaaagggccttattcagacctctagggtaacagtcctcaacctgtttaacaccagggactggttttgtggaagacaatttttccatggaccaggcagggaggggagaggggatggtttggggatgaaactgttccacctcagatcatcaggcattagttagattctcataaggagcacacaacccagatgcttcacatacacagttcacaatagggtttagtctcctctgagaatctaatgccgctgggctccatggctcatgcctgtaatctcagcactttgggaggccgaggcaggaggatctcttaacgcaaggagtttgagaccagcctggtcaacatggcaaaacctcatctttactacaaatacaaaaattagcttggtgtagtgatgcaggcctgtaatcccagctactcgggtggctgaggcctgagaatcgcttgaacccgggaggtggaggttgcagtaagccgagatcgcgccactgcactccagcctggcaatgaaatgagaccaaaaaaaaaaaaagagagagagagagagagaatgtcatgctgctgatctgacactgacaggaggcggagctcaggcggtaatgctcacttacctgccgctcacctcctgctgtgcagacaggttccaagactggtacctgtgggtggcttggggttgggaactcctgctctaggggaatagtcaccaaattagtctcagggtaggaaggacacactagtctgttgagttgttccatttcagattcttttgattaggtagatgcaaaaataattgtgattctcaccattaatgacccaaaccgcaatttcttttgcaccaacctactaataaccaaagagatttccttaattagaagttatttggactccgaaatcatatggagaatgaatagtaagtagatattaagatgttaatttaaataacgtataccaatagaacaaaatatacgtaaggtatgtgtatgaccataatggagtttcgggtctttaattctattcccttctaaaaagtgtactgtgcaggtcgtaactaggaattttgatcaggaaaatgcagctatcctgcatttatctccctctgcaggccagttctgttccctaccagtcttctttggtcctggctggtgtgcatcccgtttcaatctggctattttattctttcatgaagacatgtatattaattaaaaagaatctggtgactctgtctgcaattacaaacgttgggactttgtaatatcaatgacaatgacttttacaaatttacttcttctcttctgatcctcgttgcccatgtcttatggttcacttccctgtctgtcactgagccttctgtagttgcatgctaaatttcagaaatgctttttcctatgtttactcaggaggttttcactggttttataaatttttagaacttttaggttgaagatagccttataatgactatttacatgtcaaaagataaaaaaaggtctttgaaaatgttttctccatttttgaatatgatgttctttgaagtgattaattagtttattggacttccaagtgaccatagctttcctatgtcttgattgagaaaatacagaataattgcaacttcctatctagtaactcacgaataacttgatattttattaaacaattgagaatgtttacctgaaaaatggtagagaatgaaaaacattatttttttctgatctccttgggatgttttatggatgttgaattcaagaacattaaataaaatgaacttataattatttaaactgttgatggcccaaacttttagaataattgttctgtgtttatctcctagatcacagtgttaaatggcagacaatgggaaagattacactttttctcttttattatatctactggacagcattttttttttttttgctgccaataatagaaaccagacctcgataactaaacaggacatacaattattttaagagttgtgaatatctctcagatcaataggaaggctggacaaaacagaaatctggacctcagtatgttcacaccatacagcagctgggatctcccctcctccccggcaggtttcagatatgcagtgctgacttttcccctctgccatctcggccatcagtgctgtcactgctaagagtaacctcccaagatttattcctaagggagtatgtagttttactaggaagacataacttaacaatatgtaccattagagggaaccttgagataaaatataccaaatcataaaatatgtgtttagacaatgtaagagatgagtaagagatatattatagttaaattattattattgagaaaaattcatggaagagatgctttcactattggctttgattacatccagttcatttcatgctgactgatcattggaaaattattttttaaatttattttaattcaaaactatacattatgtatttatgttgtataacacgacgctttgatatatgtatacattgtgaaatggctaagttcaggaggttttcattagtttcataaattgttttttatatttccgtcctttgactaacatctcctcaatctctcacctctagcatctgttaaccatcatataactctctgtatgagtctgacttttttaatactccacatataagagattccactcagtgtttgtctttctgtgcctggctaatttcacttaacataatgttctccagttcatccatgttattgtaaatgatttccttgtgttttaaggctgaatagtgttccactgtgtgtatgtgtgtatataaatcacagtttctttatccataatctattcatggatacttaggttaactccatatcttggctattgtgaataatactgcaatgaacatggaagtgcagatatctctttaacatactgatttcactttctttggatatatagccagtagtaggtttactagaccatatgttagttctgttcttcttattgggggacctccacattgttttctgtaatgattgtagtaatttgcattcccagcaacagtatacaagggttcccttttctttgcatccttctgaatatttttatcttcctcttattttatgatagccattctaatatgtgataggtgatatctcattgtggtttgaatttgtgtttccctggtaattaatggtgttgagcaccattttatatacatattagccttttgcatatcttcttttgagaaaagtttattcaggtcctttccctattatttttaattgagttatttgttttcttactaatgaattatttgagtgccttatatattttggaaattaaccccttaccagatgtatggtttgcaattatattcttccattcagtacattgtctcataactctgttgattgtttcctttgccgtgcagaagatttttagtttgaagtaatcccatctgtttattttgacttgttgcctgtgcttttggggtcagatacaaaaatcattgatcagatcaatgttgtggagtttaccccatatgttttcttgtagtagttttatcgtttcaggtattacattaaagttatttacccattttgagttgagtattatatgcagtgtgatacaagggtctaatttcattttgccagcggatatccagtatttctagtgccatttattgaagagactgtccttttcccattgtgtatttctgtcatctttctcaaaaatcagttgaccatagttgtgtgtatttctgggctatcctttcaaatagtataatgcctgtcttcatttcgctcaaaactgctttggctattcagggtctttttggttccatatgaatgttaggcctgttttttatatttctgtgaaaaatgtcattggaattttgataggaattgtattgaatctgtagatagtttggggtattatagacattttcaacaatattgattctttgaattcatgaatccacttatttatatatccttcaatttcttccatcaatgattcacaattttcagtgtacagatatttcacctccttggttaaacttattccaaaatattttactatttcttgtggttttggaaataggattgttttctcaatttctttcctgatattttaatgttagtgtatagaaatgctgctgaatttttaatgttgatttttttcctgcaactttactatattggtttatgagttctaacaatttttggtagggtctttagatttttccatgtgtaaggttatgtcattgtcaaacagataacattttatttctttctgattttatgctttttgtttttgtctcttgcctaatttctttgtctagatgtaccatattatgttgaatagaagtgatgaaagtcaacattcttttcttgttactgatcttagagaaaaagctttacgtttttcaccattaagtatgatgttattgtgagctagtcatgtttgacttttactatgttatgttaccttctttctgtacctagtttaagtattcttatcatgaaacagtattgaatactgtgaaatgctttttctgcatctattgagatgatcatgcagtttttcctccattctgctaatgagctgtatagcatttagtgatatatatgttgacccatcattgcctttgagaaataaatcctacttaatcacggcatgtgaccctttttatgtgccgttgagttggatttgctagtgttttgttgagagtccttgtatctacattcatcagggatattgacttgtaattttctgggtttttttttttgtagtgttttgtgtggctgtggcatcagggtaatgctggcttcaaaaatacatttttaagtacttcctgtttaattttttgaaagtgagaagaattggtaccagttcttccttaaatatttgataaaattaggcagtgaagccatgattttctgggcatttctttgtgaggaggttttttgattagtgattcaatctccttacttgttaaggagaagttggcctaaacagatttttatttcttgattatttaatcttgataagttgtctaagaatttattcattttctggttatccactttattgacatataattgtcatagtagtctcttatgatcccatgtgtttctgcgatgtccattgtaatgtcgcctctttcatttctgattttatttgagtcttcttttttctttgttagtctagttagacttgtcaattttgttagtcttttcaaaaaatcaactctcatttcattgatctttttattgtttttcatacttctatttcatttatacttaatattttcttccttttattaactttggacttagtttactatttttctagttctttgggttctaacgttatactgtttatttgggttctttctttttttttatatagatgtttatttttataaacttccctctactattgcttttactgcattccgtaagttttgatgtgctgcatgcccattttcatttgtatcaacatttttaaaattttctttaaattgcttcattgatccatttttttattttttattttttatttatttatttattttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgctcccggcctgatccatttttttaaaggagcacggtgttgcatttgcacacgtcaatttttcaaaatttctaccttttttgacatccagtttcatataattgtggtcaaaatagatacttgatattatttcaatcttcttaaatttgttaagatttgttttgtggcctaacatatgatctgtcctggagaatgtcccatgtgtgcttgagaagaatattattctgctgctgttggatggaatattctgtacatgtttgttaggttcatgtttgtagctcagtatcaatgttgtcttattgattttctgcctgtattatctgtccattgttaaaagttggttatgaaaatctcatactattattgtcttgtgggttaaatctcccttcagatctataaatatttgctttatatatttagatgctccagtgttggatgtatatatatttacagttgttttatcctctttatgaattgaccactttatcactatataatgaccctgtttgtctctttgtatggtttttgtcttgaagtacattgtattaggtaaatatatagctagccctgtttcctcttggttgttgtttgcatggaatatttttattttatcattttgctttcaatctatgcgtgcttttaaaggtaatgtgagtgtcttgcaggcagtgtatagttgggtgtcgtttctttatccattcagccatgctctgtcttttgactaggggatttaatctattcacattcaaggtaattatggacatttcaggattgactattgccatttggttgatttttttttctggttgttttgtaaattttttgttcctttctttcttacttgctatgtttctttgtgattagatgtctttatctagagggtcactttaatttctttctttttgtcttttttttaatctaccataggcttttgctttgtgataacaatgaggcttaccttaagcatcttattgttataacagctattttaatctggtaacaacttaactttcattgcataaaattactctatgcttctacccccatacattttatgttttaaatattaaaatttacaccattttttgttgtatatcccttaataaattattatagctattattactgttaaaagctttgtttttaaccttcattctaacaatataagtgaattatacatcaccattacagtatcagagtattctgcatttgtgtacttactttgaccagtgagttttatactttcatgtatttttgtgttactagttggtatccttttcttttagattgaataaccctctttagcattttctgtaagacaggtctggtagcagtgaatcccttatttattgtttgtctagggaaatctttatatctacttcattttaaggaatagctttgcagagtatagtattcttggttggaagatttttttcttgttttatatcaacactttgaataggtgactactcagaagtctactgccaggcatattagtgctcctatacatgtaatttgcttctttttccttgttacttttagaaagttctcttgatttttgatgatttgaatatactatgtcttgttgcagtcatacttgaattgattctgattggagagttctgaccttcctgtacctggatatttttaactttctgcaaatttggaaagttttctgctattatttctttaaataagcttttcaccctttaccactttctttttcttctttgaactcctacaacttgaatattagctctttgatgctttcctataaatcccataagctttctttattcctttttattcttttcctttttcctcctctaactacatatattcaaataatatgtcttttagttaacagatgtattctgcttgatcaattctgctgttatgctattacatttttatttcatttattgtattttttagcaccagaattttcttttttaaaaaaaatttcagtctatttaatttctaattttggtcactaattgttttccttacttcattgaattatttctcgtattttctggacatttgctaagcttccttaaagtaattattttgaattcattgtcagtaagtttctacatatctattttggggggatcagatactgtgggatttttgtgttgttttggtgttattaaatcttttgtgtttttcatattgtttcttttgttgttgctttaagttgatgtctgcacatttgctagagcgatcaccttttgtagactttacagggtaggttttctgtggaaatgtctctctgtgggggtatgcaaggacacttacttggtgagatgaggtggttttcgcaccaatgaaggtgccagctgttagtctctgtgcagcattgataatgttgttgttgataaagattgaaaagtggctgatgttatgaatgtcagcaatgacactgaggggtgttaaggcctttggtggccatacctgctaagattgccagaatctctcttggcactgaatctggcctgttggcttgcttgcagtggtggttgcactggtgtttgataagtgatgtgtccatggagtagccacggagctcaggcctgaagcatgggcacatgtagaaggagtacatctctggaattggggcagtatttactctggtgtcctgagcacagacaaccctaatgttgagtcgataatagtatgtatggtagagatatttgtgaagtaaccaggtagctaagaatgggaacacaggcatgagcaaagttacagtagctctgtagtcagtgtatggtctagctctctacagtggctgagccagtggctggaacatgggtacatgcagcaagggcttggctcaggggctgtagtacaaaccagcttactatggtgttggctttggtgtttgcaacatgagtgagcccagtgtagccacagagccagggtgtgtgtgtgagcatttgtggagtacccacagctctgtggttgcacatgtgcagaattgggagaggtggtagctcctttcccctaattaatgaacatcatccacctactgggggcatagggttcagctacatctccctctcttggtttccctgccaggagtgactctcggttacctaggtggaaagagatgccagtgttctctgtgaagcatgctgttgaagactacagtggtttccacttcttggctgatgctgatagcctctgcctttcttttttgcttctggccacttcctgctgtctcaggtatgttggccttaccaataattcttgctatatgaatattctttgagtttttttttctacattgtattgccatagatttttaatgggtcctatagctctctctgggctgttttgctttgtgaatagctgtctatagctgtttttcttgggagaggatgtaagatgatatctcctattctgccatcttggtcccatcatctacttcaacatttgaattaacaaaacaccacaatctcaattataacaaaatttgtcatttctctcagagtgacagtggtatcacaattttcattataaatcctctttgctatggcttatgtcttatcatattaatttatatgaggatgaaagttcgcattaaaagtggttcagctcatataaaaattcctttcaaaattaaaaaaaaaattatattttccaccaagcaataatcaactaaaccataatttatccaaaaggttcactacatttctggctgaaacagaaagttattgtgaacaataaaattttaccagcagttagcttttttttctcagaatagtttctattaatatttaaaagtattaatgcaatagctattttatactcaggtacattgcctctaaatagttagattttaccaattattattccagtaataaactgaccagttacttattcttttctaatatttaagctgttgttatagatgtttaaataaataaatttgagagttggatatatatcttctttgcataattataacactctctataccatattatgtacatcataaattgagaagttgattaaaaatgtcatgtccctgcatgtatgaaaaagagatttaaaaatgaaactattctaaaattatggatttttctagaaacatgaaaagttgagaatgaaatgataaaaaaggaagtagggtctttcaagtaccattcaacattaccaaaactgtgtaaaaagtagacattaaaggagagccttgcataatctttaacataagctcctttattttcttaatgcatgcaaatttctgagccctttccccaggatttatggttcacaggttttggtgtgggtttcagtaatttgcatttaataaatgcctcagttgacctcaagtaattttgatgcaagtaaactagttttcacacattgcagaaaatcatgcttcattgtccactagttatgtgtgagttttaaaattaaagtttttattaattataaaaaaaaatttatcctgacctacaatagcatccctagtacctctaacactttgcttcatttgtcttttttgttttgttttgtttttgagatagggtctcactctcttgctcgggctggagtgcagtggtgcaatctcagctcaccgcaacctccacctcaagcaatcctcccattttagcctcctgagtaactgagactacaggaacacgccaccatgcctggctttttttttttttttgtatttttggtagaaatgaggttttgtcatgttgcccagactgatctcaaactcctgagctcaagcagtgtgactcagcttcccaaagtgctgagattacaggtgtgagccaccatgactagccatcttttgtctttatatacttattactacttgacataatattatatacattttcagattttttctttattactataaaccttatgagggcaggaacttcaccagtgttcgtcacttcttttccttcctctgtatttgaaatggatatggtaggcttgaaatgcagtagaaattaattcactgaggttgttgcagtatgcttttttttaaattatcctttaagtgctgggatacatgtgcagaatgtgcaggtttgttgcataggtatacatgtgccatggtggtttgctgcacccatcaacccatcatctacattagttatttctcctaatgctatccctcccctagccctctaccccaccaacaggccccagtgtgtgatgttaccctccctgtgtccatgtgttttcattgttcacctcccacttatgagtgagaacatgtggtgtttggttttctgttcctgtgtcagtttgctgagaatgatggtttccagcttcatctgtgtccctgctaaggacatgaactcatcctttttatggctgcatagtattccatcgtgtatatatgccatattttctttgtacagtctatcattgatgggcatttgggttggttccaagtctttgctattgtgaacagttctgcaataaacatacgtgtgcatgtgactttatagtagaattatttataattttgggggtatatactcaataatgggattgcaaggtcaaatggtatttctggttctaggttcttgaggaattgccacactgtcttccacaatggttgagctaatttacacacccaccaatggtgtaaaagcattcctatttctccacatgctctccagcatctgttgtttcctgactttctaatgatcgccattctaactggtgtgagatggtatctcattgtggttttgatttgaatttctctaatgaccagtgatgatgagctttttttcatatgtttgttggctgcataaatgtcttcttttgagaagtgtctgttcatatccttcacccactttttgatggggctgtttgtttttttcttgtaaatgttccttgtagatttaagttccttgtagattctggatattagccctttgtcagatagatagattgcaaaaattttctcccattctgaagggtgcctgttcactcagccccaaatctccttaagctgataattaacttcatcaaagtctcaggatacaaaatcactgtgcaaaaatcacaagcattcctacataccaataatagacaaacagcaatattctttactattccaagagtgagatgaaataagtgtaaatactaaaagttgttgcttacagagggtggaattgagtgctttattctgttttttttaaaaatacttttccattttttatgaattttatacattgaacatatagtactttataatcagaaaaaaacaacatttaaagcatgatacatttaaaactcattttattttatcatgcagtgtagattttagctctttcattgtgttaggcagtgccaactttggttgagtaagataataggcaccaggtacatttaaaagctctctaaaattatacagaagagagaatcacaaatggtcttttaagtcaccacaagggaatttatacaaaagtgtaaggttttgcatataattaatataaggttttacagagaagatgttttatggaataagagtaagcaacaaagaaaatatcttaaaaattcaactttagttttcttcatgaggtctaccttccaaaaatagagtgactcctagaaagaagttcttttttgtgggtttttaaagtcaacttaaatacatctctcaccttcatctccagcactcacatttgtactcaatatttaactgattatacccaggcataatttctagatgcatactgtgtataatgttgctgttctcactctcaatgcatgattcacagggagataagagtactattttctgcatttggggacctatgtggtttattcaactatgcataatgcataatctgccactttgtaaagagataaggtgtatgctgtactggttgctcttttgaaatacagtaatcactaaaatttttattttctataaaattggcattaaatataggagtgatattatgtgtatgcatatataatacaaatgccattacaaagatccaatcacatttatataatttttttcaaattagctgactaggagttgtaataagacattgtttttaattttcagtatatttaactgtcagagatatttaaaaagtagaaattcaattataagtaattaggctggttttgtttttagttactagtttattgtaatagttaacattttcaggagaaaatggatataaaatgaaatcttttttcctccattaaggaatctgacacttgaaaagattaactgtgtaaataattcatatggggatataagggattaactaaaatatataattttaaagaaaaaggaaaaatatagaaagagcaacagaacctccaattttggtgagcagcatataggttgtatgaaaggaaaaatacaaaccaggggtggaggtgactggaattcagatgtgtcttttgtattccttgggtggctaaccataggcaaactaccaaacctttttgagtctcacttaaaacatgaaaaatctagtaattagactgatcttgtaaattacaaaatcagtttaccccctataaaattttctcttacactttggatgattatatgtcaggtattgttgttacttgtccagctgaggcatggtacccccgtggagtaggcttggagttcagttcggagctttaattagcagatttgctaaatggcaaagaccaactcatacagttattctctcttagataatcacccaatttgggaagagtgatgataagaatctcttctcatgaagagcactcaagagctgagtaggaccagtagtaactactactggatgatctgtcattggcttctttagagtgcaatcttgcttcttggctagacagaaaataaatgaaatcagtaatttctgacctgacttggatgtcagcagtatgaattcaccagaatcctactaacttctccttgcatttacctgtgtagattgccttgatttgggaaagattataatttgattcccccaaattgaaatataacatatattatgaatagagtaggctttctttcagcttaaaccttctcttcattcattgcaagctattgcattcagacaaaataatttaatatatgtattttaataactataaaataaaaaaccaagaagctataattgaaaaccagaaaggagactttgccagaaacctagaagcccaaccctcttgtgtaattctccccaatcacaactccatctcttcctgttagactaccttaataaaaaacacattcctacctttcttagcattttgcatcctatgtttagattcctaaaaataagtttccttatttttgaacttgcatgaacagattcattaatgaaaattgtgcctttttattttctgctttttatcttaacacggttttatgaatttctttcaagatgttgcacgatgctgtagtttgcttgattttttttttactatggagtcctcaagtgatagagtaattttcatccatcttattgtagatgcacacgttatttaatttttagctattaaaagtagtcctgctataaacattgttattgatgttgttcattgtggagattattcatgtattcttgtactcttttgtatctgtgtcgtaggagtggaattgctggataagacaatgcaagtggatcttgagagatctcaccaatgaagtcatttggaactagagttttcgaaaagactttgaatactaatttaattactttaataactatagataggactatccacgtttgtgagttatcttaatatttttctcagaatttgactttttatttaaattttaaaatgcaggagcataaatttactcttaaaattctcttttgcagcattttgataatgctcttattttcatttgtgacgctaggtcttgaatcttctttcttgattttttttctctttctgtatattgctccagtggtttgccaattttttaaaaaaactctccaaaggtaagtttctggcttgatcttgatccttcctatttttatttgttttctattttattattatttttcttatagttttttttggcttgttttgttgctattatgctgtttctttttaatatattcaaagggatccccagtctattaacaatctacaatattttttttaaaagtttactgtaagttctgggatacatgtgcataacatgcaggtttgttataggtatacatgtgccatggtggtttgctgcacctatcaacccatcatctaggttttaagccccacatgcattaggtatttgtcttaatattctccctccccttgccccctggcccccaacaggccctggtgtgtgatgttcccctccctgtgtccgtgtgttctcatttacaacatttattttttattgatatatacatctgattatgtgatggctttataatatgtcaacttggctaaatttcccagaattccctgtatgtttccagttaaagtgggttataagaggattgtgtacaataacagagtacatgaatgaagcaacagctcattttgtagctcatctcctgatttttttggctattgacctgctgacttgcccctctgatgtaaggcagagtctgcacctgcaattgctccaccttcttctggttacttcttcagtgtctgtgactctggagtcaggtgtatgtatttagttccattgaaaagaggcttggtttctacaggacactcatacaaccaatgtcagagacagcaataactaatctgggtttcaatattgtctcttgagttttggctttgtttgtgaattctagcttgttttcattcttctcgacccttcatccacctttacatctcaactgtctgctctgtggataacaagctctaacatcaggtgtcttacagacatcttaaaaagcttccaacattctgtaaggtcaatgttttgtaataaatctcttaatattaacatatgacattcaatggttcatctctctggttgaatcctgactggtacagaagttatgcatttttctctaagtttttctgccaccatcacttttatattttattttgtatgtgttaaaacatgattgtaactctttctttaattcatatgtttttacacagacatttttgaatttcgaaacttataaaatatttatcattttctaactgattctctatttagttacatattaggaaatatgcttattccaacttttaagaattatgcatttctttgcagttacatatgatgaatctttgtaagtgatttgtgtgtttgaaaagaatatataatctacattcatttggtaattgttttctaaatatgatcaattatgccaagaatttatcatgttaaaattttccacattcttcttcattttctatcttcttcttgttttatcagttatcaggtgttgaggtagttatttaaaactttttttcgagggtggagccaagatggccgaataggaacagctccggtctacagcttccagtgtaagccacgtagaagatgggtgatttctgcatttccatctgaggtactgggttcatctcactagggagtgccggacagtgggtgcaagacagtgggtgcagcgcatcaagcgccagccgaagcagggcaaggcattgcctcactcaggaagtgcaaggggtcagggagttccctttcctagtcaaagaaagggatgacagagggcacctggaaaatcgggtcactcccaccctaatactgcgcttttccaacgggcttaaaaaacgacacaccaggagattatatcccgaacatggctcggagggtcctatgcccacggagtcttgttgattgctagcacagcagtctgagatcaaactgcaaggtggcagcaagcctgggggaggggcgcctgccattgcccaggcctgattaggtaaacaaagcagcctggtagctcaaactgggtggagcccaccacagctcaaggaggcctgcctgcctctgtaggctcaacctctgggggcagggcacagacaaaaaaaaagacagcagtaacctctgcagacttaaatgtcccagtctaacagctttgaagagagtagtggttctcccagcacacagctggagttctgagaatgggcagacagcctcctcaagtggctccctgacccccaagcagcctaactgggaggcaccccccagtatgggcagactgacacctcacatggctgggtactcctctgagacaaaacttccagaggaatgatcaggcagcagcatttgcagatcaccaatatccactgttctacagccacggctgttctgcagccaccgctgctctgcagccaccactgctgatacccaggcaaacaggatctggagtgcacctctagcaaactccaacagacctgcagctgagggtcctgtctgttagaaggaaaactaacaaacagaaaggacatccacaccaaaaatccatctgtacgccaccatcatcaaagacaaaagtagataaaaccacaaagatggggaaaaaacagagcagaaaaactggaaactctaaaaagtagagcaccgctcttcctccaaaggaacgcatctactcaccagcaacggaacaaagctggatggagaatgactttaacgagttgagagaagaaggcttcagatgatcaaactactccgagctacaggaggaaattcaaaccaatggcaaagaagttaaaaactttgaaaaaaaattagacgaatggatacctagaataaccaatgcagagaagtccttaaaggagctgatggagctgaaagccaaggcttgagaactatatgaagaatgcagaagcctcaggagccaatgtgatcaactggaagaaagggtatcagtgatggaagatgaaatgaatgaaatgaagcgagaagggaagtttagagaaaaaagaataaaaggaaatgaacaaagcctccaagaaatatgggactatgtgaaaagaccaagtctgtgtctgattggtgtacctgaaagtgacagggagaatggaaccaagttggaaaacactctgcaggatattatccaggagaacttccccaatctagcaaggcaggccaacattcagattcaggaaatacagagaatgccacaaagaaagatactcctcgagaagggcaactccaagacacataattgtcagattgaccaaagttgaaatgaaggaaaaaatgttaagggcagccagagagaaaggtcgggttacccacaaagggaagcccatcagactaacagtggatctctcggcagaaactctacaagccagaagagagtgggggccaatattcaacattcttaaagaaaagaattttcaacccagaatttcatatccagctaaactaagcttcataagtgaaggagaaataaaatacttcacagacaggcaaatgctgagagattttgtcactaccaggcctgccctaaaagagctcctgaaggaagcactaaacatggaaaggaacaaccggtaccagccactgcaaaaacatgccaaaatgtaaagaccatcaaggccaggaagaaactgcattaactaatgagcaaaataaccagctaacatcataatgacaggaccaaattcacacataacaaaattaattttaaatgtaaatgggctaaatgctccagttaaaagacatagactggcaaattggataaagagtcaagacccatcagtgtgctgtattcaggaaacccatctcacatgcagagacacacataggctcaaaataaagggatggaggaagatctaccaagcaaatggaaaacaaaaaaaggcaggggttgcaagcctagtctctgataaaacagactttaaaccaacaaagatcaaaagagacaaagaaggccattacataatggtaaagggatcaattcaacaagaagagctaactatcctaaatatgtatgcacccaatacaggagcacccagattcataaagcaagtccttaatgacctgcaaagagacttagactcccacacaataataatgggagactttaacaccccactgtcaacattagacagatcaacgagacagaaagttaacaaggatatccaggacttgaactcagctctgcaccaagcagatctaatagacatctacagaactctccacaccaaatcaacagaatgtacatttttttcagcaccacaccgcacctattccaaaattgaccacatagttggaagtaaagcactcctcagcaaatgtaaaagaacagaaattataataaattgtctctcagaccacagtgcaatcaaactagaactcaggattaagaaactcactcaaaaccactcaactacatggaaactgaacaacctgctcctgaatgactactgggtacataaagaaatgaaggcagaaataaagatgttctttgaaatcaacgagaacaaaaacacaacataccagaatctctgggacacattcaaagcagtgtgtagagggaaatttatagcactaaatgcctacaagagaaagcaagaaagatccaaaattgataccctaacatcacaattagaagaactagaaaagcaagagcaaacacgttcaaaagctagcagaagggaagaaataactaaaatcagagcagaactgaaggaaatagagacacaaaaaacccttcaaaaaattaatgaatccaggagctggttttttgagaagatcaacaaaattgatatactgctagcaagactaataaagaagaaaagagagaagaatcaaatagacgcaataaaaaatgataaaggggatatcgccaccgatcccacagaaatacaaactaccatcagagaatactacaaacacctctgcccaaataaactagaaaatctagaagaaatggataaattcctcgacacatacaccctcccaagactaaaccaggaagaagatgaatctctgaatagaccaataacaggctctgaaattgtggcaataatcaatagcttaccaaccaaaaaaagtccaggaccagatggattcacagcaaaattctaccagaggtacaaggaggagctggtaccattccttcagaagtacaaggaggagctggtaccattccttctgaaactattccaatcaatagaaaaagagggaatcctccctaactcattttctgaggccagcatcatcctgataccaaagcctggcagagacacaaccaaaaaagagaattttagaccaatatccttgatgaacattgatgcaaaaatcctgaataaaatattggcaaaccaaatccagcagcacatcaaaaagcttatccaccatgatcaagtgggcttcatccctgggatgcaaggctggttcaacatacgcaaatcaataaatgtaatccagcatataaacagaaccaaagacaaaaaccacatgattatctcaatagatgcagaaaaggcctttgacaaaattcaacaaccttcatgctaaaaactctcaataaattaggtattgatgggatgtatctcaaaataataagagctatatatgacaaacccacagccaatatcatactgaatgggcaaaaactggaagcattccctttgaaaactggcacaagacagggataccctctctcaccactcctattcaacatagtgttggaagttctggccagggcaatcaggcaggagaaggaaataaagggtattcaattaggaaaagaggaagtcaaattgtccctgtttgcagatgacatgagtgtgtatctagaaaaccccattgtctcagcccaaaatctccttaagctgataagcaacttcagcaaaatctcaggatacaaaatcaatgtacaaaaatcacaagcattcttatacaacagagagccaaatcatgagtgaactcccattcacaattgcttcgaagagaataaaatacctaggaatccaacttccaagggatgtgaaggacctcttcaaggagaactacaaaccactgctcagtgaaataaaagaggatacaaagaaatggtagaacattccatgctcatgggtaggaagaatcaatatcgtgaaaatggccatactgcccaaggtaatttatagattcaatgccatccccatcaagctaccaatgactttcttcccagaattggaaaaaactactttgaagttcatatggaaccaaaaaagagcccgcatcgccaagtcaatgcaaagctggaggcatcacgttacctgacttcaaactatactacaaggctacagtaacaaaaacagcatggcactggtaccaaaacagagatagatcaatggaacagaacagagtcctcagaaataattccgcttatctacaaccatctgatctttgacaaacctaacaaaaaacaatcaatggggaaaggattccctatttaataaatggtgctgggaaaactggctagccatatgtagaaagctgaaactggatcccttccttacaccttatacaagaattaattcaagatggattaaagacttacatgttagatgtaaaaccatagaaaccctagaggaaaacctaggcaataccattcaggacataggcatgggcaaggacttcatgtctaaaacaccaaaagcaatggcaacaaaagccaaaattgacaaatgggatctaattcaactaaagagcttctacacagaaaaagaaactaccatcagagtgaacaggcaacctacaaaatgggagaaaattttcacaacttactcatctgacaaagtgctaatatccagaatctacaatgaactcaaacaaatttacaagaaaaaaacaaacaaccccgtcaacaagtgggcgaaggatatgaacagacacttctcaaaagaagacatttatgcagccaaaaaacacatgaaaaaatgctcatcatcactggctatcagagaaatgcaaatcaaaaccacaatgagataccatctcataccagttagaatggtgatcattaaaaagtcaggaaacaacaggtgctggagaggatggggagaaataggaacacttttacactgttggtgggactgtaaactagttcaaccattgtggaagtcagtgtgacgattcctcagggatctagaactagaaataccatttgacccagccatccaattactgggtatatacccaaaggattataaatcatgctgctataaagacacatgcacacgtatgtttattgcggcactattcacaatagcaaagacttggaaccaacccaaatgtccaacaacgatagactggattaagaaaatgtggcacatatacactatggaatactatgcagccatacaaaatgatgagttcatgtcctttgtagggacatggatgaagctggaaaccattattctcagcaaactatcgcaaggacagaaaaccaaacactgcatgttctcactcataggtgggaattgaacaatgagaacacatggacacaggaaggggaacatcacacttcagggactgttgtggggtggggggaggcaggagggatagcattaggtgatatacctaatgctaaatgatgagttaatgggtgcagcataccaacatagcacatgtatacatatgtaacaaacctgcacattgtacacatgtaccctaaaacttaaagtataataataaaaaaatttaaaaaactttttttctatttagttcttttttaaacaactttattaaggtataaatgatatataaaaaactgcctatatctaatgtgcacaatttgatgagttgggacaaataaaaatacccatgatactatcatataatcaggtaatagatatatccaaacctcttaaagtttccaggtgtcctcttgggtttttttctcttttttgtgtgtgttaggaacacttaatatgagatttacctcaaaatctcactccagttttggagtgctataccatatggttaattatagccactgttttatacagaagatctttagaacttattcatctagcaaaacagatactttatacccattgaacaactccccattttccctaccccacaatcctcagcaaccactgtttgtagtctttgcttctattaatttgactattttagatactgcatttaagtaaaatcatgtagtatttgtctttctgtaactggcttatttcatttagcataatatctctaggttcacccacgttgtcacaaatggcagaatttccttctttttaaaggatgaatagtatttcattatatttatatgtaatttttttttctttattcatctgtcagtggacacttggattgttgtcatgtcttggcaattgtgatcgatgctgcaatggacatgggagtgcaaatacctcttcaaaatcctgatttcaattcccttgggtatataccccaaaataggattgctgaattatatataatagctctacttctaattttctgaggaactttcattctgtttactataactgctttgccttctaccaaactgcttttacacttctacaaagaatgtacaagagttccaatttccccatatcctctgcatttgtaatcttttatttatatttttttgcaacagacatactatatccccttgtagctttgatttttctctctctgacacttaataattgagcatattttcatatacatcttgtcaatttttgtgtctttgttggggaaatatctgttcaaatcctctggccatttttcaattgggttattatttgtctatttgaaactgcagtggtctcatatatctttaggaattaaccccttatcagttatatggtttccaaatattttctcccattctgcaaactgactttttgttctgtagaatgtttcctttgctgtgcagacgcttttttgtcttatgtattctcatatgtctatttttccttttgtggcctgcttttagtgtcatatccaaaaagtttattgcaaagaccaatgtaaaaaagttttcctctgtgctttcctctaggggtttcaggatttacatttcagcttttattgtttctaaagaaaagatcttgaaagtatcttaaaatggcttgtaaagctctagttatgaactaactttttagaagcctatgtgacaatagatcagaaacatactgattatgtttatcctaaaatgcttaagcgtttaaggattaataggcaaagatataggaaacacaggttagacatttccaaaggcaatagttttgagtttaggtctttaacccattttgagtttatttttgtgtatggtgtatggtaggagttcaattttactttttgattttcttttcatgtggatatccagttttcctaacaccatttgctgaagaaaccatccttttcccatcgcaaattcttggcaccttttcaaagatcagatatatatatatatatacacacagacacacatacacacatatatatgtatgtgagtttattttggagttctctattctgttctattggtttatatatctgtttttatgctagcattgtatggtttgaattaatgtagctttttaatatattttaaaataggaaagtagtttgcctctagatttgtcgttcttgctcaacattgctttggctactcaagatcttttgcaattccatattaattttagaattgtcttgtgtatttctgttaaaagtgccattgggattttgatggagagtatattgaatctgtagatcatttttggtattttggacattttaacaagaataaatctttcagtccatgaacacaggattttttttcaattatttgtgtttgtttaatttcttcaaattaataaaatcaagaatggaaaggagaccttatgagtgataccacagaaataaaaaaattatgagagactactatgaacaattaaaagccaaaaaattgaataacctagaagaaatgaatatagtcctagatgtatacatcctccaaagactgaattatggataaaaaaaatctaatagaagcaatcagtaaggagactgaatcagtaattttaaaactcccaacaaagaaaagcccaggaccagactgatggcttcactattgcattcctccaagcatttaaagaattaacaccaattcttctcaatctgtttaaaacaattgaagaggagagaatacttccaaactcattctatgagtccagcattatcttgacaccaaagctattcaaggacactacaagcaaagaaaactacatttcaatatccctgataaacatatgtgcaaagatcctcaacaaaatactagcaaaccaaattcaacagcacattcaaagaaccacacaccaagatcaaggggaattgatccctgggatacaatagatgcaggattttttgctccttagttcagctaaatctggcttcttgtctcatgaccaggaaaaattaggcatgtggacacattgaaaggtgaggacagaatttattaagcaaaaggagacctcttaacaaaaagaggggtcctgcatgcaggttaccacttcacaaattgaataccaggccaccacacatgagatgatgaggcctggctcctcccctgcgtaaggtatgaattcctggtggctccaccccattcttccagtgtgcctgcaggcccctagtctgagccatttcacattgatttatttcccttactacgcatgtgttaagggaaggggtttcttaccatgggcatattaaggcaagcttcctgtgcacaatgacctggatggggcagaggttctgtgggacccttccctatttgtctagggatttggctgtctcctgtctctatcacaaggattgttcaacatacgcaaatcaataaatatgatacatcacattaacataatgaagaatgaaaatctcatgatcatctcgataaatgcagaaaaataatttaacaatatttaataccctttcatgatgaaaacactcaacaaactagctatagaaggaatgtactttaacacactgaaggacatacatgacaagttgacagctaacatcataatcaaagttaaaaaaattaaagctttttctataagatcaggaataagacagggatgcccactctcatcatttctatttaatgtaatactgaaagtcctagccagagtaattgggcaacaaaaaaaagaaaggaatccaagtccaaatgaaaagaagtagaattatctctgtttgcagatgacataatcttatatgtgaaaaacccaatgacttcaccaaaaaagacattagaacaaacaatcaaatttggtaaagatgtgagaaacaaaatcaatatatgaaatccagttggatttccacatattataagggaaccatttggaaaggaaattaataaaacaatcctatttataaaagcggtagcaagatgctcatatccatttttaagtctgcattacctctggcctgctctctagtgtattctgacaaatagtcttcttactgcttgagttcatgtaaacaacacagcttttgagaagtctttcttcattgcctctacatggaacgaaatattcctctccagatctctttaagtttgattgtaagtctattatgttgtgtttaaaacctcctcttatctctttgggctgacaggaaatttaatctccatcactagtatacactgtcccttggtttgtgtcttcccatcaaaaccagaggaagatccctggagtcacttcttctgagacatctgttgtttgagtatttatcaatatttcaggtcttacagttagttctcatgagtttctgctcttcttgggtcaccagtgagtttggcaaggctgagaggagggattgcaataaggaggcaaactagtaatactcataatgtttaactgcttgatcactaataatggcaataatgatagtattatattaaagtatgaagactatatagtataggaaaaatcaataaaactaaatatgttaaaattaaaacatattagaaatatcagacaaaatgtcaatctagcaaaaatataagtgttaaatatatgccttagttctggctgctaaaacaaagtatcatggactgggtatcttataaacaacagaattttattgctcagagttctggaggctggaagtctgagatcatgttgccagtgttgtcaggttctggtgaagacattccctaagatcgcattgtgtcctcaacgtggctgaaagctgggcactctctgcaatctctttcttaggggcaataatcccattcaagaaagctccaccttcacaaatttaattacctcctagtaccatcatactgagggttaggacctcaatacatgaattttgagggacacaatcatttagtctgtgacaaaataacatcataaaatgataaaattaatataataaatgttatccaaaaaatagtgctttataaaactgaagaaaatttaatttcctgtgattattaaaagttaaataatgcaatgtaatttctttgtaaaacttggatcctctagaaaagtgaattgatgtgataattactgagctgaatatacttctatataagagtttccatctgttggaaacgttatttccaacagtgggaaaatgtttagtagacatttatgaactaactccaaatagttcccccatgagttcctcatctttaaataatcatcagaagtacaattaataacactgtagacattttccaacacctgccccacaatacaatgcagagtgtcaatttgatactatggtatttatatttcacttgttcaaaggtctttaaaatacggtaataattgtgtttaaagtaggagaagttttacaaagacagaatatagttgcttattgaaatgtgtacagggcagatctgtctaaacttgtagacagcactttgtggtgtcttttcttttgcacatattgatgagctacaacattgattttgttatcaagatatacaagactaaaatatcaggttcttttaaacacagaaataataacattgcattaagaagtattaagtattttcatacataatacctgttattctagttgctgcttagagatgctgtgcatgagctccagctgtcctagagacaccaaccattcatcctctcggagttctggctatacttccaggtaacaaactctagacagcgctcaggttcccagccctcaaaccccttttctgtctgatgaagtatctcttttctatatcccttcttgctctgggattcctggcattaggtcttcaatgaacttaagatttcactaaaatatagttttctacatgcaaaaagccacaaagcaagaaaattataagggtctagtaatatgcttggaatgcaggaaagggaaaaaatacagtgaacaaaacacatgcttatatttcaacaagatagctagcataagagaaacaaacttgtcatttaggtcaatattgtattaatttcattttttattgaaatctatgttgctgtatacattaatgaattttttattttgaaatatgtagtctaactcaacttttagtgctaatataatgactacgaagatagctattactatattattcccctctataagtttatatttaggaagaaaataagttaatgtaaattaattaatataattctctgaaaataaactgttactataataacttcataaagataaataaaaactgtgccaaaaatttatctttgtgcaaatcatcacttttctcatctgtgaagcaggtcctaaagcttttctcagttaacaaagtattttctgtttttaatattgtgagaatataacataatctaggcatatattgtgagaatataacataatccatgaaactatactaacaagtaatgcccaactccctctccctatttctaaaggattttgtgaatgcaaattgtgtttattaagaaatagttaagggatagttatttgttaaatgagtacatgaatggataagtttatgcctaaatagtttggtttatagtttccttttatgtgaccacaaattatcttcaccctgtggtaacatagactgacaatgatattattcacttttgtatacatcaggatgggagacttggaaagatcaagtgattttcttaaagaggcattgatttattggcagtgctgagaatacagtctaggtttttctgccttcatgtttagagttttgctatcaggcagtatggtttcccagtgggcagtgataatcatgcctcaaaggaccataaccttgctaccatctctccatcatgaatctattctgactcagctactggcatcagtgactgaacttctcagtatatacatgagtgagcctataaatatgcatggtcgagggaagtagaaaacatccttggtctttggaataaaagaagacttaaacttgattctggatgtcaatatttactaactatttaggcagactattcaattctacatcagagtaacaacaccaaattattatggaataattttgagattaaatatcacaattgcatgagaagacacttagcttatagtaaacaacacaataagggtaattttattagaacaccttagttttattttctaaattcatcaacctcttttaaggttttctctttatcacataagagaaacctagaagtacattttccaaaattctcttctccacatgtttctggggtagtctgatcatgactggtatctaaatactatttggatggtgaagcattgacaatatttgctgaaaaacattaacaagaagcacagattttcttgggaaagagagagtgtaatttgcatgggggaataatcttgagtatttaggggcaagacagaggatgtgataggaatacctctgacaaaatatttcagattctgccatcctgtcacattgtgggataacactttgaatttgggagagaccatgtgattggttctgaccaatgatttataagcagaagtgacttgtatcatgtaaaggccaagcatttaaatgcttcagtgagttctctttccactgtgttgaaattcctggcaatgctcaaaatattagctattctgaagcttggttagctaactgactacagtgagccctgcagattttcagtgagtatgagccacaagcatgagcaagaaacaaaccttagctgtttgtgatagataagataatgtgtttccaatgatgtttgtgtcctaatccctggaacctgtgaatatgttactctatatggccaaaaggattttgcagatgtgattaagtgaagaatctttaaatggaaatattttcttgaattatctgggtgggcccaatgtaatcaaggattcttaaaatgtttattgaagtggaagtcaggctgatgtgattgctggctttgaagctgtaggaagaggctacgaatgcagatagtctttagaaactcaaaaaggccaagaaaatattcttacctagagcctccagaagggttttaacccaatggaatccatttcatactttggacatccagaactctaagataaatttgcattgtttaagccactaatgttatagtaacttgttagagtagtaacaggaaaccaagacagtacacagttttatgtcatttgaggtttaaggtagtttactgtagcagcatgatctagcctatcttgactgataaaatctgcccttacctattttttaatggtcagcactaacattgagaaaatatacttacaatttcaattggtggtttttcaccccatctttatggttttccttagttgccctcctcctatgtttgaatcagggtatagataaaatttgaatgttattatcattagttatgtattttctaggacttaatctaaaatgtgataaagtttctgtctttgaggggacccatcatacactgttggtggggatataaattgatgcagccactatgaaaaacaggatggaagttactaaaaaattaaaaatagagctacactgtaatccagcaaccctgcttctagctatatgtcccaaggaattaaaattagggtctcaaagagatacctacattcccatgttgattgtgtcattagtcacaatagcaaagacttggaagcaacctaaatgtctattaatggatgagtggataaagaaaatgtggtatatactctgaaagaaaaataaatcttgggaccccaaaatcactaagccaaagagaaaagtcaagctgagaactgctcagggcaaacctgcctcccattctattcctaaaaaagatagctattaagataaaaaaaaaaaaaagctacatacctccctcacaaggaatttccctgtgggcaaaggacagacagaactcaaagtcacctctctgctcactgagataaatgcatatctgattgcctcctttggaaaggctaatcagaaactccaaataatacaacaatttgtctcatatctacctatcacctggaagccccctccctgcttcaagttgtcccacctttctagatggaactaatgtacatcttacatatattaattgatgtctcatgtctccctaaaatgtgtaaaactgagctgtcatggggcacacccttatctttggcaaaataaacttcctaaattgattgagacctatctcagatatttggggttcacaatatataccacaatgaaatagtatgtatttcaatagtaatgaatactattgaattacaatggaatattattcagccttaaaaatgaaaagaatcctgccatttgcaacaacatggataaacctggataaacctgaaagccatcatgctaagtaaaataagctggacacagaaggacaaatactacatgataccactgagaaaagaaaaatagctcagagcagtctgaattttgtgaggtatgttaaaatttatccagttcagacagacatgagtatggaacttcagtcatgtcccccatccccatgccccagggatagttgtttaaaggcaattgcctcactcattatcttcatgatcatgaaatttgtgatacagagaataatgtataatcaattaatagcttatgttattttaatgtaattctcagttaaaaaaacaaaaacttaggaatggtctctccttttcctttaaaaacccattcataatcagagcatatattcaggacaactggaatctatgcccctgggtggctgtcctcaaacttggcccaaataaactctctacttatattaagtttgcatgaattttttccccctttagttcaacattacttatgtgactaatctaaaataatcagactcatagaagcaaatagtagaatgaaggttgccaaggactagagggagaggaaaatagagcggtattaatcaaagggtacaaagttttcctcatacgcaataaataagccctagagatccactgtacagcataacacctacagttgacgatacagaattttatacttaaaaatgttctaggatagtagatcttatgttaaatgttcttatcacaaaaaataaataaagaaggtaggaggaaacttttggaagtggtgaataagtttatggcatagaatgtgatgagggctttatgggtgattacttatctccaaactcatcaagttgtacacagcaaatatgtacagctttttgtatgtcaattatacctcagtggagtggttaaaaatgttctcttaaaatctcaattttgttcttgctctctattggtttgtgagagataacataaatttttatgcttctagataagatgaaaagatacaacccatacatactatgcaggagataaaccaacacagtcactttattaacaagtttattttgtgaccatatattcttccttcaagaagatgaaagcggtaaaccttcagggaaattgtaatattgagatcaatgtaaaatttcactgaagaactcaggtacaaaatgtcacacataaaagtggattagaagctgagctattgtgaagagatgaagatgaagaaatattttcagaatgtgtttcttatgtgaacttctgtgtggaatccagaagggagtacattgatgcaggagctagaaacaaaaaagaacggaaaaaaaaaaaaaccaaaaagcaatattttctgatgttcaagcatttctctgtaaataacccaaacccagagctgaatgtgagacaagaatatatatttgaaaaaaatagcacttagacctagaatcaaataaaataactgataccttttttaatggaagaatatagggaataaatattaaggaaaatgactaggagggcatggattctaattttgttttttttgaaacatagtctccctctgctgcccaggctagagtgcagtggcatggactttgctctctgcagcctcagcctctgtggttcaagtgattctcctacctcagccatccgagtagctgtgattacaggtgtgtgctaccgcacccagctaatttttgtatttttagtagagatgggattttgccatgtggcccaggctagtctcaaactcctgagctcgagagatctgctcgcctccgcctctcaaagtgctggtattacaggcgtgagccgtggagcctgtccagatttttatctggcatcttcataaatgtgttttttctcttctctttcttttacctacacatgacacacatagatttctaagtgcacacacacatacacacaaacacatattttatatgtgcaaatatgtcaaatatgcaaacccacatttgcatatttgattgtttttctggatatctaggaacacctgttctaagtaatcttttctggaagtgtgcagggaagagaagaaaaaaaatttctctgtggctccccagaaatgccccacagaagttccccttatgggtcattgtcaaggagtttttctaggagtgtgggaaatgcccattcttttcacccctcccctcagttccaatcacagggagagaacttctctgcactgtctcaacacattttctgtctggcagttatgaaagcttcctgtccagattgacattctacagtctcagtacatctggtgggtgggagatatcttgatatcttgtcagttaatattttatgccaacgtacatcttacaaatgaatgtcttacttctagcagcatctagttttaatataatcttatatacatcatccatccttctctgtgcaggaatatgttcggaaaaatattgcagttcaaattctcctttaaactacaatattttcttttaactttctacattaacaccattttgcacaaatatacaaaattgtccaagttctgcatgccagacttctttagtcattgatttgttgcctataaaataatatttaacttattgcttcagcaatcattataaaaaaaagttctaatttttattgtagaaagaacagttaacatgagatctactccattaaatgtttaagtgcacaatgtagtattgttaactataggaaggcttctgctattttaacacagaccaaagcctacataactcagctactcaaggaaaactgtcctgtggcctgtttgggcgcaatgtagattacatttcctcctctgtgttttcaaaaaactttggcatatttatattactacaatattcatattcttcatactacactttgattatctttaaaacaatacactatttcagcaactccaggcttgtgttcatacatgtttagcaaccagttctcccctgcccaataaaaggtgtacgcacatatatatttacataggtttcttatgaattttactaacataaagtttgtgtagcatatgatacgatatactacatacaatatatgcaataatacgtaagtattcaatattccatattttaaatccaatgtagtcaattgatgctcacataatgtttttgttgatatttttactaaaatattatgtccacagtaaacttatcactgcaactaatgggtgagtatagttaaaatatgaatgttaattgatacttttatttatgtcaatgagtcagatgaaagtgaaatgacaaacacaaaaaacatgtttgaggacttcatttgttagtcactagtatgagtgactttgttaagttgcataatagttctcaaatactggagtattatttactctaattattgtgctattgatggcataactgctacagacaacacactttaagttaaatcttccttatgaacatgttctccattattttcttattccttgacagtcaacacggcaaaaactcaaaccctgattggcagcatttgctgatatctgttgtgtaaatagtctcaccacagcctactccaaggtattaagatgacaatactgagaacagagctggggaaaaatgcacagcggcacacctttatattgtatttccattgcacagatgcaatagacataaataacatcaagagcatagataatagtaaaatgtaaaataggtagaaaataatgagctttgagtaattattatattgaaaaaataaaacttatttaattgtaaatttatataatttcattttaaataatatctctatttaacaagtcgctctgaaaatgcttggaaatttcacaatcggttcttgcgtgctgatatgtattggctccattatagcactgactgcttctctgtcttgttttttcagcatttttgcatgcagcaggtgatcagaaatatttttgtggtgaagagcaagttataactttacccagtatgttacaccaatatcccgttttatacaccagtgactgttaaaagcagaattacattctctactcaacagacttccagaacaagtgagtttattctgtctgtgtgcattccagcctgggtgacaagagtgagactctgtctaaaaaaaaaaaaaaaaggctggaatgcagtggcacaatctcggctcactgtaacctcggcttcctgggttcaagtgattctccttcctcagcctcctgagcagctggaactacaggtgcgtgacaccatgagcgactacttttttgtatttttagtagagacggggtttctttttttttttattattattattatttgaaagttttctctaggattgacgttctcttcctttcaagtatcataggccaatctttttttatttttttattatattttaagttctagggtacatgtgcacaacatgcaggttacatatgtatatatatgccatgttggtgtgctgcacccgttaacttgtcatttacactaggtatatctcctaatgctttccttccccgctacccccaccccacaacaggccccggtgggtgatgttccccttcctgtgtccaagtgttctcattgttcaattcccacctatgagtaagaacatgtagtgttggggtttttgttcttgtaatagtttgctgagaatgatggtttccagcttcatccatgtccctacaaaggacatgaactcatccttttttatggctgcatagtattccatggtgtatatgtatcacattttcttaatccagtctatcattgatggacatttgggttggttccaagtctttgctattgtgaatagtgctgcaataaacatacgtgtgcatgtgtctttatagcagcatgatttataatcctttgagtatatacccagtaatgggatggctgggtcaaatggtatttcttgttctagatccttgaggaatcaccacactgtctttcacaatggttgaactagtttacagtcccaccagcagtggaaaagtgttcctatttctccccatcctctccagcacctgttgtttcctgactttttaatgatcgccattctaactggtataagatggtatctcattgtggttttgatttgcatttctctgatggccagtgatgatgaccatttcttcatgtgtctgttggctgcataaatgtcttctttgagaagtgtctgttcatatccttcgcccacttgttgatggggttgtttgtttttttcttgtaaatttgttggaattcattgtagattctggatattagccctttgtcagatgagtagattgcaaaaattttctcccattctatgtgttgcctgctcactctgatggtcgtttcttttgctgtgcagaagctctttagtttaattacatcccatttgtcaattttggcttttgttgccattgcttttggtattttagacatgaagtccttgcgcatgcgtatgtcctgaatggtattgcctaggttttcttctaaggtttttatggttttaggtaaagacgaagtttcaccgtattagccaggatgtttttctcccaatagtgataccttcttctctcagctctcaggctcctcacaggggttgccttcagctctgcctcccaggactcttaacctaaggcactgttactagtattattattattattattattattattattattattattattattattgttattttgagacagggtctcatctgtcacctaggctggagtgcagtgggactatctcagctcactgcaacctccgcctcccaggttcaagcaatcatcccacctcagcctgcagagtagctgggactacaggtgacagccaccacgcctaacttttttgtattttttgtagagacggagtttcaccatgtaggccaggctggtctcaaactcctgagctcatgatctgctcgcctcggcctcccaaagtgctggtattacagttgtgagccaccgtaccaggccctttgttactataattatcgttaaaataattatttatccaacttcacttcaaaatttaaatgtcagttttggcattatgtcagcacatacaccttatttccaaattaaatttaactgatcaggtaaataataataataaattaaatcctagctattgtatatctttaaactgaagacttctggaaataatagctaagtctcagtggggaaatctagtactggggattcctgggttgtggcagcctttggaagtaaaagttgagtgcctggaggcactgcagtgctctggtaactctaccattcagagctttgcccttcacaggcccatgtccataagattcacaagaatattgatgtgagcacccattgcattgtgggaaagagccataaagagacacgcttaagtaaaaagccacttcaagtttttaaaaatattttttcttgaaagaagaaatttaataaggttaaatacgtcaaaacaaaagcataaaataacatacatattttatgtattatgcaagaaatgataccacatgtagaaattacattgtagaaatactaaatattataacgagaaataatttttcaatgtttaggtttatataatgagaaagagatattccagaggaataaaggtaaaaagcacaagggttaaaagtgtgtgggtgggaaaaattgtgtgtgtgtgtttaagagagagtaagaggtaggagagagaaagattctgagattttagcagggcattttggctttattatgtattttcttaaacttgtctcttattctttgcctcttattgctttctcttgccctcttgacctccggagcctacttccttttgacacctctcaattattgagcttactttcctagagattaaaaaaccaaaagtttatgtgcctcagatgtagagtcaatttaaatacagacataaattatggttattgcctttggggtgtgtgtatgtgtgtttgtgtgtttgtgtgcatgtgtgaaggcaccagttttggatttagatagatctgggttcacaatttgactccttacattttctcgcaatccaaaattggtcaagtgtcttgaattctgagagttttagtttccttatgtttaaaataggaccaataatatgtaatccaaaagactgtggagaatgttaaattagataatgtatgatgaccttgacacatactgtaaagacttagtaatggattacttttgtcattatcattattttattactgtgaatataagaacagttgcaagtatttaattgcaagtaattaacatatttttattactgttaatataagcacagttacaaattgtaaaagagataaatctaatcaaagagtcaatgagttactcccattaggtgtcatcttttttttttttaaacacagattctaggaaacaaaagtgtcatcttataaagtgaatggtaagcacttggacagccttcaaattgaagtcaaagtgcagtttcttaaatatcaaatccatcaaaagagagagaaggttgaacagcactggagaataatcatagaaaatgtactttgtcaagttgaaaatcttttcagactcatggtattctaaggttagacatacttcactgggatttcagtccagtgaaatctagagaaacgtgacttttttgtctctaaatacaggagttaagaagaaattacttaggcagatagtgagagtacggaagtcctcggtaagcttttctttcaatgaaaagcaaccccaaagcattttcctttctaaccaagagcagcttgtaaaatcaagctaggcagacatagatgccatcagttgtgccaatcatgttcaagatggcagctccatcttcccttctctttgttagccacctgtatagtaaggagcagataaggtggctctggtcaaaggggaagttcatttgcacaataagattaaggtggggccaccagccttccctgcactatgtaaatgtcatacctgatcaaaccaatctgtgagtcctatgtaaatcagacacctcctcctcaaacctgactataaaatctggcacatcctccactggccggtctttttctctctctcactagagagagaggtgttttcctttttctttcttttgactgttaaacctccgttcctacattcctcgtgtgtgtctgtgtcctaaattctcctggcaggagacgatgaacctgggtatttaccccagacaatgcagctgcttcataaagacaagatcttgaaagttctaaaaaatgttttgaaaagctcatttgtcatgaactaactttttagaaaaaaaaaatactttagtgacttaagtaacaacaaatctgaagcatactgattctgtttgccttgaagtgcctatgggattaaagactaacaggcagagagataggaagacagtttagacactttcagaggcaatgcacttaaccaattgaattgctaaacaaacgaactggaaaactttgtttctgtcttttttggtctgtggtgctatcacaaattataagatgaaaataactctaacgtttgctttatgtagtttcattgcattttttattttaattctttatattatcagttacagagacaagggaaaaatctaatcaggcaatcattttctctttctacagtttaaattatttagttacacctgcaatgtttggcaataaaaaccaatttgggattttggtttgattattaggaattttttctgaccgtgttttttataacttggtactcttttgcctttttctaatatacagttgtattttcactgttttaagaataagcttactttggctctctttagaatcacacatatctattcagagttaaaaaaagaaattaaaatgcaatatttaaatgtgttatgaataaaacactattatgataaaaatctattcattagctaagaatagaaaaatgaacttacaaaagtgaaatcaaagagactaaagtgatgtagacttcctttcttttcagcaattgatagaagcaaattcagttgctattgaaaaacagtggaagtaacaatattggctggatgattaagcaaggaagatgagaatagaggggaaaaaaagcataaattagtctgtggtctgtaggtctggatgacttgtgaccttgagtacatttccagttgggttacagcagcgactacccttcaaacactaccaccctaagaagtacaggagtgacagattaacttcccttctttgacagagatggaaaccaatcattaactgctatatcaaattcttaccaatagccaaggtaaagagcaatatagttttcttgagacttagtaaagcctaactaatctaatttgattttattaaagaatgacaaattgaataaatgaggaaaaatagttcaaagtgttttggttaataagaattttacttttgtttaaaggagaaacactatgattttctttaagccaacattttactgtgaggtatcagctaatttattatttaaattacaaaatcttgagttaacatatatcctctatcatcttcaacaagactagaaataggcaccctcatttaattcccagttcattttaaaggaggacaaaaaggctagtttctgcctatcattgaaattgtaagacgctgaaaggacagaaaatattaagtgaagaaatgattcaattttgacctatttggttcaagatcctgtgctgcaaattatttcaatactctagcttcactatataccaacaattatgccttaatgtgccccaaagcgagtttcattttacttcctctttgaaacccaaaatatgtttaaaattgtgttttgagtctgcatttatttatttatttatttatttatttttaatctgaaaatgactttgtttgtttttttttgaatttcacattctagtaccttacttttttttttatactttaagttttagggcacatgtgcacaacatgcaggtttgttacatatgtatacatgtgccatgttggtgtgctgcacccattaactcgtcatttagcattaggtatctctcctaacgctatccctacaccctccccccacctcacaacaggccctggtgtgtgtgatgttccccttcctgtgtcaatgtgttctcattgttcaattcccacctatgagggagaacatgcggtgttgggttttctgtccttgcgatagttggctgagaatgatggtttccagctttatccatgtccctacaagggacatgaacttatccttttttatggctgcatagtattccatggtgtatatgtgccacattttcttaatccagtctatcattgatggacatttgggttggttccaagtctttgctattgtgaatagtgccgcaataaacatacatgtgcatgtgtctttatagcagcatgatttataatcctttgggtatatacccagtaatgggatggctggatcaaatggtatttctagttctagatccctgaggaatcaccacactgacttccacatggttgaactactttacagtcccaagaacagtgtaaaactgttcctatttcagcgtggtcctggtaccaaaacagagatatagaccaatggaacagaacagaaccctcagaaataatgccacacatgtacaaccatctgaactttgacaaacctgacaaaaacaagaaatgggaaaggattccctatttaataaatggtgctgggaaaactggcgagccatatgtagaaagctgaaactggatcccttccttacaccttatacaaaaattaattcaagatggattaaagactttaacgttagacctaaaaccataaaaaccctagaggaaaacctaggcaataccattcaggacataggcatgggcaaggacttcatttctaaaacaccaaaagcaatggcaacaaaagccaaaattgacaaatgggatctaattaaactaaagagcttctgcacagcaaaagaaactaccatcagagtgaacaggaaacctacagaatagaagaaaatttttgcaatctactcatctgacaaagggctaatatccagaatctacaatgaactccaacaagtttacaagaaaaaccaaacaaccccatcaacaagtgggtgaagatatgaatagacacttctcaaaagaagacatttatgcagccaacagacacatgaaaaaatgctcatcatcactggccatcagagaaatgcaaatcaaaaccacaatgagataccatcttacaccagttagaacggcgatcattaaaaagtcagagtctgcaattattttaaatcctactactctattttgtaatggaattgctagggatctctcgaaaattttgaaactgtacttttgaaatgcaccgaaatgcaaaattggcaaatgagtagaatcctgtttgtagctcttattattctttctcatgttacccaatttcatatgactttttccaatgatgggtgccaagcataaaccaaatggttaattgattaattcaatacatatttattgggtacctgtgtgctaatattattagtcactgtgctagactctgagtatgtgaccttgagctaaatacatatgatgcctgtctttattctgtgcatgtactagcttagaagacaaatatgcagaaacagttgccacagtaggagaatggtgcttatgagtacttaggaagaggacctaaattagtattcagtcatggagaggccaaaagaaggtttagaggaagcttactgttgtaaataatatataaaccgagacctaaaggatacataggcaaaacacagtgtaatggaggcaacagcatggcagaggcaatggcaaaattgggatctgagagaaaaaaagagcagggattaattcaggaactgaaacaaaatcagtctctggaactctggtatgagaacaggaaaggcaaaatcaagactggagaatcaggtgatggagagcctggtatgtcactctaagaaatgagattttctacaaacgccagtaggaagctactaaaagattccaagctggggactaacatgatcttaattgcattatgtaaatggggatattaaaatgataattttctgtttctgtttttgctaaagcctcaagaaaataagtaccaaattctctgaggggtagactgctcaaggaagatttgcaaagggtgtctccaacaatggattttgcaactcttagctgactatcaatctgcagactactgaagagggtagagacactgagatacagaagtgagagactggagagacaatttatgtggaaggaattagtgtgccatgaaatgtgccacctctctctttgagagagttggagttttagataactgaatatttgtcccctatagtttggggaacaaagacctgggaaaaagaaaagaatctcactgcaataatctgttaacagcaaactataagctgtggtttgggtgtaagagtttgatcacacatttctcattaatctgatgaggagaaagagagagagcaacagagagagagagaagatgagtgtgagcatgttggagatcaagcaatcaagtaactttgaagttatttttcctaaagagattttatcaagggtgatgcccacacacggactactggaaaagacaagacggaggtggcagatgtcagtggccctgcagagagtgcatcatctgtgccaaggaagtggaagtggtgatctcagagatggcctatatgggcaaatcccacagtcagtggtaaacccctttcacagccacagaaatggaagtgtaaatctgcatgtaaaagctgatattcattgagtgccagtccagagagcttttctgtccccttcttgtcctttggtcttctcattcccatcatggagatgccagaaaccacatagctagcagggagaaaagcagacaaagtcctttccccactgcaggcatctcacatgtaacacgtaacactggcccaggggaaatatgtttaaatttcacagcttttattatttttctggggtggacatgttattaataattactaactaaatggggctgtctaaggtgacaggacagagagaaaaagatcaagcaccacagagcagatttgtaggagaaatggggaaaaaacaaagttgcttcattcttacatcttgagtgtgcttctctttcagtgcattgggtccacttagaagggtgcctctgactgctgtgtgaaaatgattttagccttacttattttgatgctctggtgtcagatgtataccaattaaggaatgttatttcttcctagagaattgaccccattattatttcttatgcccctctttatcctgataaatttcttgatctaaaattagctttgtctgtaattaatatagctactctaactttcttctgatgagtgttaccatgattatctttatttctgtttttacttttattcccttttaaatacactgttttttttagggcagttttaggttcatagcaaaattgggcagaaagtacagagaattttcatatattctctgcccctcgatccatgtcctacattgaagtggttcatttgttataaatgatgacgcatcattatcatccaatgttcataatttctgttagagttcactcttggtgttacacattcttggttttacacatttgacaaatgtatacgacaagtatccaccattatagcaccacacagaacagtttcactgctttggaagcttctgtgctggaaactatgacgacagtaaaaagatcagctggtgaccaggggtaggggaaaggaagacatgaataggctgcagggaggccttttccagaatgtcctatgattaaaatcatgaagtatgtagccttttcagattggcttttttcatttagtaatatgtattttagtttcttctatgtctgttcatgacttgctagctcatatctttttagcagtgaataaatcccattatctggatataccacagtttattcattcatatgctgaaggacattttggttgcttccaagtcttggcaattgtgagtaaagctgccataaacattagtatgcatattttgtgtggacataacttttcaactcattaggtaaacactaaggagcatgattgctggatcatatgacaaaagtgtatttagttttgttagaaactgccaaactgtctttcaaagtgtctgcttggcatacctaccagcaatagatgaacattcctgttactacacatccttgccagcatttggtgttgtcagtgttctgaattttggtcattctaacagtggtatctcattgtagtggtgtagtttagtggtatattgttttaatttgcagttccctagtgatatgctatggagtatttcttcatatccttatttgccatctatatatcttcattgataaagtgtctgttcagatcttttatccatttttaaatcagttcgtttattttttattatcaacttttaagatatattttgtatattgtggatagtagtccttcatatgatatgacttttgcaaatatttgctcccattctgtggcttgtattcttcttattttcttgacagttttttcacagagcagacatttttaattttaatgcaatccagcttattaagtatttctttgatggattatgccattgatgttatatctaaaaagaaatcaccacacccaatatcatataggttttcatctatattaaattctaagagttttatgcttttgcaacttacatttaggtgtgtgattcattttgagtttatttttgtaaatgttgtaaagtctgtgtctaaatacatgtttatcctgtgggaacactatatgacttcacagtagtgcaggtatcttacaacagagtattcccaattccttcttctcatctctaattatattgctgttacttatatgtataattatccattgttattattattactagtaacaagtacttaattttaggtcaataaagaacagggaaaatgaaagattcatttgtttctcctctaacattcctgagctacatcatttttattctctctgaagattttcttttaacactttagtatttaccttccttggtgttaccttagatttttgaattggtggtttggtggttttcattaattttgtaaaattatcagcattattccttcaaaatttcttctgctcagttttctctttttttcccttccagtattccaattatgtgtacaatacaaatttagaattatctctcagttcttagatgctgtttgttttgttcattcctttttctgtttgcatttcagtttctattgtcatatcttgaagtttattgatgatttccttagccatcttcaacctaccgatgagcatatcaaaagcattattcatttccgtgacagcattcttgatttctagacttttgtttagatatttttaaaacaagaatatccatctctctgcttacattggccatctatttatgcatgttgtcttcttgttttcattagaactcttaaatgattaattattgttgttttaaattctctgtcttataattccaacatttgtatcatagctgagtctgattttgatgcttgctttgtctcttcatactgtgttttttctgactgttaatttcttttttttttttggtagaaaactagacatgatatattcgggtaatagtgactgagaaaaaggtctttagtgtgagattttattgttaatctgactaagtctaatgtttgctctatttgtaagtgccagagactccaacttctgctagtgttcttgttttttgtcttctccttgaatctttaccttgcacctctttcagtgcaatcctctgatccactgtaattgtactggtgccctatggatgtggtggtgtgttgaggaaggtggttgaaagtgttctataaacttcctattaaatttgagtctgtgtccttggtctgtgaccattataattctattaattttctctttagcaatttctaaatccactgagcttttaatttcagttactagatatttatttctggacatacagcttattcttgcaaaacttgttgtttttacttatgttttaagcctctttcatttcttgggaaatattaaaaatagtttcagaaatgcatgcttctcctgcaaattcaatttctgaaggctttgtgagtctctttctgttatctgtttctgcctattcttgcttatatattggtttttcttatatgttttataatttttgattattaattgccttttaaaggaggtttatatttgtaaattcttttaggcttatgaaaatggtagattcttccaaaaaagattttctttgcttctgtcaactgcctgtgagtcttaccaatttacattttaaactaaattcttgacttcacatttttcttattatccaggtgctgtgaattaggcctgaaaacttacatgataggttctggttattaattttctaggaagatttttcatcttctctcctccccgtcttcatatacagggataaagatttgagaaagatttttatcatttattaccacagttagatgtagagctttttttatttctaatttgctaagagtgaagctctcttttgttccttgctttatagtggaaaccaacatattagactccccagtttgagaggaattggggcattctcttctatccccacagcactctgaaactttcaattcaaagtcaagtttagcacatgttttacctatctgtacctctaactggaggaaaaactaaatttgcttacatcttagccagcatatttctttctttcatgacagctcttgaatacatttataaagatatatttgcattttatctaccagtttaattagagagattagcttattggttattccgctgtaaaagtagaggaagtgaaactctatgggctggacttctgatccctgcattgcttttgaaagtttggttacagatctgcctgtcaaatgcagatctcctcatagggtactgatacattcacagaactagatattttgtttctttcttctgaaatgttgacaagatttatggatgatacatgaaacacacaatagatgagaaaggtcttgcttctatcaaaatcttgatggaattgcaacctggctatggagaatctaaaattttgtttttgacaaccaatccaaattgataatactaataggcaatgaggatacttacttttctcatcttctttttctttctctctagtgggcattttatagttcttttaaagtcatatttggtggaggtgggattggttctatttattatttaagggtttagctgatttcagacaatgattttcagatctactgagaattttaatgtgggagtacatctccaatcttttgagtcatgctgccactgactacctatgtgaacttggacagtttgcaaacttacatatgcctctgatttctatttgtaaaatgaggataaaacaatactacttccctcataatgttcctgtggctattcctggccgaagcatagtaaaacattatatatatgttagttgtgatgatggcgatgatgatgaagatggattgagaagcatggagtttaagaaaaaatgtttgcaagccttagcataatcctgttcttaggagcctgtcctggggtttatttgtgctcagaatactaatctggatactttaatccttcaatttctacagaataagatagatggtcagttttaacacatattttttatcttaaatcatttgattagaatgaggatgctttaattattttttctctaactcgatctggtttccaccccatcacaaaaccatcactgacattttgcacttgaaattttcagaagtcaggctaacctgcccgttttctcaaagtgagaaattggataataaggataatcccttcaaaatcttttaactgctttccagggattaagtctaaagtcttcaccatataagctccctagaaaattggcctcaacctcactttccagtttaattttctcttaccctgtaccttgcaatccagactgttctctgaatgcactatgactttcacatctttgtctttgagccttcctaacaactcctctctgataagagtgccctgccctgcatttcttcttatctagactgactcctcctctctgcccccagatttgttcccttaaattgctctcagcaatgcaaccagagcactctttgaaaaatgcacattgatcatgtcagtctcctactgaaatcccttaaatataatagctgttagttgctttaaggaatagagttcaaattcctgagtatggtttacaatatactcataatttttctgggttcatttttcttctgcctgcctcacagtttgctgagtcacttccagccctttacatgccatttcctctacctcatatgtctctattttacctcgtttatcttgggcatgggagaacttctattaaattcattcctcagatttagggttgccaaataaaatacagaacacccatttaaatttaaattttagataagagcaaatttttttttagtataagtatgtcccaaatattatacaagatacctatactaaaaaattatttgttgtttacctaaaattcaaacttaaatgaacattctgtatatttatttgctaaatcgaggtcagattttagaaccaagtcaatgtgttctcttaacatcttgtactttgtggcactaaccatagtatactgaaatggttgtttatctaactcttctaatagacagtttgctctttggggacaaggggtatgtatttttcactgtattgcctgtagcaattactagagtgagtttagtgccagaagatagcaaccattgaacaaagaggtattgaataagtgaatggatgatggaaagacgaatggatggatatgttagaaatcctattaaatacctcttcaatacaatcttccctggcatattcccaggaaaaactacttggtaattatctctgtgttttggtaacaccttttacatatttctttcatagctcctattatacatgttttatgtataatacttacaactgtttgtttttatgtcatataccttcctaattggtaagcatccaacagttagagattatgtcttcatcatctcattgttgtactttctgccctccacattgacctgctaatcactgttggagactaatgtgattgattaaaagagggggcattcagcacactctttggaaggaaatgtttatctgaatgaaaatgtgatattcaattattaacaaagaatgtgcttttcagttatgttaattagagactggtgctgccagatcacctattgagtaatttgttcaaatatgaataccctcttttaagaaagatacaacctaaagattacacagagaaaagtgctcaagataacaatagctaatattatgtaccaagtagtgtgctataaaatttaaataaatcatataattaaatttcataattaccttatgaagtaggtactaatatctccatatttacatgttagagatgtaagaattcgacttaaagatgtccccaacattttgcatatagtaaatagtggaaaacatctaagcttctttgctaaccaagccctggctgttaaaaaattccacgccacataatatgcaaaatgattaaaggaaaggtcttgcttaatacgaagaggaaaaaaatgataaatgttatctggtatttggtaagtcaggctttttgtgtgtttccagagaacagaattaaggtcaacggtaaacatatttggctagataagagagacaattttctaacatttaagttattaagtataaataatttagcattgtaataattgtatttggattgtaattggtttgagacttctttacaaagagtactttccacatttctgggagatttaggaagtggcaaagtaaaggtgagtcacagaggagattcagcaagtggtttacattaacagattatattgcacagatttacagatgaaaaagaataggacattttgtgctttaaagatattgtatttaatgattatatgtgttaaaagttccctggctgaaactttagacatttttgtagctttctgtagaactggcaatatctaggaaaatatgacatttgaaagcaataagcatttttaatctctgaggtaataactacctccattgaatgttccatttcactatttttagtaaccatttaaaaagatcttttatcaaagcaaagcaaggttcttattgttctttggggaagtttcgcagtagcgattagctttaatgaagaggttttagactgaggaaggaagtggtacacaactacctagttgtgtattgttgagacggaacactttctttacaggcttttctgcttataaggaagaaggtttcttttgctcatgtggatttagattttactttaaagagttgcttgctgtgtttgttcttgcttgaaaattcactgacaggagctatgaaatgatgttctagaaggctgaagaaatatcgaagtggttaaagttcaccttgtaccagaccaggaatgattggcacatgaagggaaaatgtcaataatccagacttaacgggatgttctaatgttggaatattatgctttaatagattgtgttttgggagctaccagacaagagtgtgtgtatacgtccagatttctctgaatggacaaaaaatccccactgtctgtgttcccatgttgaggtaaatccagggcctgagatgggggactctctttggtcccagctattgagacctaattctaagatttagctctcttttcaggtactcacattggtcaggttaaactggtccttttcacaaagaggcaggatggagagcaaaaggggaaagcagtgttctaaatatgtaagtacagaagtacagtatcaaggaggaccggctagagcctgtggggtctgagagtagccacatgtactgttagttttaagttaccatgctgtaattctctcatgtaaattaacataagcctaaaaaaatctcattaaaagttacaaactgttttcttctgtgctggcagaactaagagaagggtcagtgccatgcctgggatctaatgataaagagcaggctataacgacacttctttataagctgccccctcaccatcctagggcattgtaacagatacagattagattactctagcatggtgggtgcttccagaatcctcagagtcattgtgagaggcaggaacacagaatagtaatgaggacccaaagaaggcaaagataaaaggacagactaatgctgaaaaagccaggaggttttaccatgtctgatgactcattgggaaataccagggggctgttgtggccatgaaaatgttgccatgaggatatcccagttaggtagcctgctgcagggagtagagttgactcttgcccatctaggtccaccccagagtttgaaccaaaacatggtcctcctacaatcttcttagccattgtgggagcccagtgaggggactcgtgccagcctgttcctacagtgcccagttcttctaatggaggactttagcttggggattccccgttgttctggccaaaaggtttctaaaactcagctgcagcctgaggctcttgccaaatccttattccttccccctccactttcacagctgtcagattagcatcacagtctaaagactcacctatctacttctgcttccttccttttaacctttgtaggtgttaacttcctcttgaggtcttcttagaggaccagaactaacattgggactgggagatttatcaaaaatggcagatgtgggcagagaacaactgtaattttggtgccaatataaatgcaaagtaattgagctaggggactttagtgatatatgcaactgtgttcagtgtatcaaattgaaaagtcacttttacaacagatctaatctacctctaggtgggagaaactggggaggagttgctattgatatcatcagtgtctctagagaaggggggcatgactgtggtaaagataagtaatgagatggggagaagaaaacatacatacatatcgaaaagctgggaaggagggttgggataagagagggagagatgcagagtgtaagaataaagaggttcagaaaaaaaagcttcaaaatgtggtgcaatgtaaaatgtagcaggtatcgagaagacacaaaagaggaaaaaatcaggatataaacacaaaaatatacattccagcaaaaatccagtaaaaatggagaaattgtgtctgggatatgtatagtacaaaccagaaaggtctcttgcttatgaatataggaaacgaaacagaaggatttaatgttacaattatttgaagaaaaattttcaaatcaaagtaggtcaaacttaaggccaagattatggccaatatgaaaaaaaagaataagaatgaagcattattgttgttagtgatccctaattcatgctattctgaactatctcggctggttcaaactataccacttcctatcagtaaaagatgggaagagtatgaaggaattaccatcagtatcagagcctttacgttacgttggcacattatgaagattaatcacacaaggctttaaacacttgctaaagatgggtgtgatggcagtgcctacagctactcaggaggctgaggcaggaggattccctgagcccagaagtagaaagctgcaatgagctatggtcaccactgcactccagcctgggtgaacttgtctctaaaacaaacaaataagcaaaaataaataaatgcctactgatatcaaacaatggaaaaacattaaaataattacatatttagcacttcttagagataacagcataattttaaggtataaatggattacactgtataaaagtaatgatgtttaacttgatcttgctttttaaatatttttttctcagtattagagattgactgacataattttttttttctttgagacggagtttcactcttttgtcaggctggagtgcaatggtgccatctcagctcactgtaacctccgcacccgggttcaagcgattgtcctgcctcagcctcccaagtagttgggaatacaggcgtacaccaccacacccagctaatttttgtatttttagtagagatggggtttcaccatgttggccaggatggtctcaatctcttgacctcatgaactgcaaaattttcccaaggttcacttttccaccagcaactattcatttgcgtattagggagctgtcaggcctctgagcccaagctaagccaccatatcccctgtgacctgcacgtacacatccagatggccggttcctgccttaactgatgacattatcttgtgaaattccttctcctggctcatcctggctcaaaagctcccctactgagcaccttgtgacccccactcctgcctgccagagaacaacccccctttttcctttacctacccaaatcctataaaacggccccacccctatctcccttttgactctctttttggactcagcccgcctgcacccaggtgaaataaacagctttattgctcacacaaagcctgtttggtggtctcttcacacagacgcgagtgaaatttggtgccatgactcagatcgggggacctcccttgggagatcaatcccctgtcctcctgctctttgctccatgagaaagatccacctacaacctcaggtcctcagaccgaccagcccaagaaacatctcaccaatttcaaatccggtaagtggcctctttttactctcttctccaacctccctcattatccctcaacctctttctcctttcaatcttggcgccacacttcaatctctcctttctcttaatttcaattcctttcattttctgttagagacaaaggagacacattttatccatggacccaaaactccggcgccggtcatggacttgggtaggcagccttcccttggtgtttaatcattgcagggacgcctctctgattattcacccaggtttcagaggtgtcagaccacgcagggacgtctgccttggtccttcacccttagcggtaagtcccgcttttctaggggaggggaaagaacccctcaaccccttctccttcacccttagcggcaagtcctgcttttctggagaaggggcaggaaccccgacctcttatctctgcaccccgatcccttatttctgtgacccgaccccttctctgcttttctggagggcaagaaccccccaccccttctctgtgtctctactctcttttctctgggcttgcctccttcactatgggcaagcttccaccttccattcctccttcttctcccttagcctgtgttcttaaaacttaaaacctcttcaactctcacctgacctaaaatctaagcatcttattttcttctgcaatgctgcttgaccccaatacaaactcgatagtagttccaaatagccggaaaacggcacttccaatttttccatcctacaagatctaaataattcttgtcgtaaaataggcaaatggtctgaggtgcctgacatccaggcattcttttagacatcggtccctccctagtctctgttcccaatgcaactcatctcaaatcttccttctttccctcccacctgtcccctcagtcccaaccccaagcatcgctgagtctttctaatcttccttttctacagacccatctgacctctcccctccttgccaggccgagctaggtcccagttgttcctcagcctctgctcctctaccctataattcttttatcacctcacctccttacacccggtccggcttacagtttcattctgtgactagccctccctgatttgcccagcaatttactcttaaaaaggtggctggagctaaacacatagtcaaggttaatgctcctttttctttatcccaaatcagatagtgtttaggctctttttcatcaaatatgaaaatccagcccagttcatggcttgtttggcagcaacccggagatgctttacagccctagatcctgaaatgtcaaaaggccgtcttattctcaatatacattttattacccaatctgctcctgacattaaataaaactccaaaaattaaattccagccctcaaaccccacaacaggacttaattaaccttgccttcaaggtgtacaataatagagtagaggcggccaagtagcaacatatttctgagttgcagttccttgcctccactgtgagacaaaccccagccacatctccagcacacaagaatttccaaatgcctaaaccgcagtggccaggtgttcctccagaaccgcctcccccaggagcttgctacaagtgccagaaatctggccaccaggccaaggaatgcctgtagcccaggattcctcctaagccgtgtcccatctgtgcaggaccccactggaaattggactgttcaactcacctggcagccactcccagaatccctggaactctggcccaaggctctctgactgactccttcccagatcttctcggcttagcggctgaagactgatgctgcctgatcgcctcagaagccctgtagaccatcacagatgccgagctttaggtaactctcacagtggagggtaagtccatccccttcttaatcgatacagaggctacccactccacgttaccatcttttcaagggcctgtttcccttgcctccataactgttgtaggtattgacagccaggcttctagacctcttaaaactctccaactcttgtgccaattcagacaatactcttttaagcactcctttttagttatccccacctgcccagttcccttattaggctgagacactttaactaaattatctgcttccctgactattcctggactacagctacatctcattgccacacttcttcccaatccaaagccccctttgcatcctccttttgtatccccccaccttaacccacaagtataagatacctctaccccctccttggcgaccgatcatgcaccacttaccatctcattaaaacctaatcacccttaccctgctcaatgccaatatcccatcccatagcatgctttgaaaggatcaaagcctgttatcactcgtctgctacggcatggccttttacagcctataaactctccttacaattcccccattttacctgtcctaaaaccagacaagccttacaagttagttcaggatctatgccttatcaaccaaattgttttgcctatccaacccatggtgccaaacccatatactctccaatcctcaatacctccctccacaatccgttattcggttctggatctcaaacatgctttctttactattcctttgcacccttcatcccagcctctcttcgctttcacttggactgaccctgacacccaccaggctcagcaaattacctgggctgtactgccgcaaggcttcacagacagcccccattacttcagtcaagcctaaatttcttccttatctgttacctatctcagcataattctcataaaaacacaggtgctctccctgctgatcgtgtctgactaatctctcaaacccttccacaaaacaacaactcctttccttcctaagcatggtaagatacttttgcctttggatacctggttttgccatcataacaaaaccattatataaactcacaaaaggaaacctagctgaccccatagatcctaaatcctttccccactcctctttccattccttgaagacagctttagagactgcccccaccctatcttaccctgactcatcccaacccttttcattacacacagctgaagtgcagggctgtgtagtcagaattcttacacaagcacagggatcgcgtcctgtaccctttttgtccaaacaacttgaccttactgttttaggctggccatcatgtctccgtgcagtggctgctgccaccctaatacttttagaggcccttaaaatcagaaactatgctcagcttactctctacagctctcataatttccaaaatctattttcttcctcacacctgatacatatactttctgctccccggctccttcagctgtactcactctgttaagtcccacaattaccattgttcctggcccggacttcaatccagcctcccacattattccagataccacacctgaccctcatgactgcatctctctgatccacctgacgtcctttaatacctgtttttctccttctcttattccgtttagtttttcaattcatacaaaactgtacccaggccatcaccaataattctaaatgacaaatgtttcttctaacaaccccacaatatcaccccttaccacaaaatctttcttcagcttaatctctcccactctaggttctcacactgcccctaatcccgctcaaagcagccctgagaaacatctcccattatctctccataccacccccaaaaagttttcaccgtcccaacactttaccatgatttcattttatttttcttattaatataagaagacaggaatgtcaggcctctgagcccaagctaaaccatcatatcccctgtgacctgcacgtacacatccagatggccagttcctgccttaactgatgacattccaccacaaaagaagtgaaaatggcctgttcctgccttaactgatgacattatcttgtgaaattccttctcctggctcatcctggctcaaaagctctcctactgagcaccttgtaacccccgactcctgcctgccagagaacaaccccctttttcctttacctacccaaatcctataaaacagccccacccctatctcccttctgactctctttttggactcagcccgcctgcaaccaggtgaaataaacagctttattgctcacacaaagcctgtttggcggtctcttcatagggatgcgagtgaaaggagccagatcctagcggtcagtgtttgttttttagtgttgctaattgactcctacaaagtttttactcaggcaatagcaacatcaggtgaaaatatagtcattaagcacagaatggaaagaaaaatttcaactttacttcattttatttggtaaaaaataatgcagaaattctaactggacacaaacaaattgacataaattagtctgactcagtttagttatttataataaccactcaccaactctcccatctccactttcccaggggtggaatgggaagccctccctttatttaaaataactaacgggtctaaatgtttcaccttacaattgctgattgtctcctgtagtgtgaaatggaacacaactaacacccaattatcagggctgtagtgaagaaaacaatgcctggcctagagtggggactcaacctacggtttctattgactcctggggagtttaacaaggtggacatcattaataaacattagctgaagaagaaaacgaacaagattgatatctggggaaaaacatgaaggttgcacaaaattaaaaggctgagaagataagaaatctaaatcaatattacccatgtaggacaaaggcacatatgatcaaataaatcatgagaccttcaaaaagaatgcatgttttgtgaagaaaaatggacagattcataaatatatgtgaagtgagaacgcaggaaaggaagattataagcccctagagagagactgaaatgaattcaatgacagaagaggcaaatgcagcaagaaaaatgaataacttatttggtttagtgctcactgaagaggacttgaagttgtactagaaagtgaaaagtctcccagagggagatggcacactcctaaaagctaagaactggaaaatcatttacataggtaacatctcattataacgaaactaacagtaccactaaattgttttattgggacaaaattttattaaaatgatttcaggtgtgaaagctcctatgaattgataaagctgggagtgacagtcagtggattcctgaatattaaaaacggcagcaaataatcagagagatagaaaatgctttatattcataaatgtgagtcatagcattatttataatagaaaattatgtaaatatacaaaaagagggaaataggtaattacattataaaatttatatgagaaaatattttaccaataaaattatgcttataaaaatacagtactaatagtatcagtaaatgcatatgatgtaacattaaataaaagaaaattgcatatagagaaaaattaacattgtaaaagataaaataaccaaaaataaccactggacgtatcaataatagaatgttaaaaatgttatctttggctattgaggttaagtattatttttattttcttctttatagttttctgaattttcaaaaaaaatagtataactgggcatggtggctcatgcctgtaatcccagccttttgagaggccgaggcaggaggattgcttgagcccaggaattcaagaccagcctgggcaacatagtgagaccccgattcttcaaaataaaattaaaaaatttagctgggcaaggtggtgtgcacctgtagtcccagctactcaggaggctgaggcaggaggatgtcttgagcccaggagtttgaggcatcagtgagctatgatcatgccactgcactttaacctgggtaacagagcaagaccccatcacaatgaaaaaataaatatatatataataaaattagtatgtactttttcatatgcatatagatgttgaacatgaatttatattgtgtaagtaggtatctgtatgaaatttttaaaaaatcaactagttctatatagctaataattaaagacagcattctcttgccccactatttttgctctcccaaggcagtcactcgcaaatctttatctgtttcttctgatatttacctccctatttttaaacaactgccatttgtatattttactaacttattcatacgggaaacaggtttgcatttatcatgcccccattcccaggacccatgcaaatattttctccctctagcctctcaatacaaatacagttatcttgtatatttagataaaatgcatattttgtgtttacccatatgggagccatctactgtcatatgattgtttcattttttcccttgtgttaagttcttgttttccttgtggcttaataattgcatccttttgtcattgttgtttctgtagatttccagattgtcagacataaacaatttccagattgtcagacatggaaagcacttctcagtgaatttaagtaaatcaaataaagtcttagttcaagttcaacattaaccactgaaaattcccttaacctagcaggtttcctaacaggggatttaaatcttaattactatacaaaggtctgaccagacctaggaggaacccccttcaggacaggatgatagatggttcctcccaggtgattgagaaaaaaaaaaaaaaagaagaagaagaagaagaaaagggggagggggagaatttatgtaaaaagaatgttatatggtaaattcttgtcctaaaataaattaactggttgtttaaagaaaggaatgtttgcaataagtcagaaagttgagacgtcgaagaatagtctgtgaaagtcgtgaaagaaaaaaaacgtgtgttacaaaaaaggaacttatgcaagaaaagttgtataatttaaaagttattaggtctactgaatgtaaaactattgaagaaacagtttatgtgcaaggtgtacaaggaaagtaaaatatacttttagtaaaaggattataagcaggcataagaaggtggatttttacctacattaaaaggttaaaaaagtttgttttgaaggtttaagcaagttttgaaacgttagtagtaaaggaaattctgtgtgtaaacatattggctgaagttaaagtggtatcatccagtttttttgtgaactggacattaaaataaaaatacaatgggcttttcttaaagcactggcctgctctttaacaaaaaattataaaaggttaaaaagagtctataaaaaatcttagcttatggtcagacattaaaaattgaataaatatgcctacaaagttttattaaaactaagtttaacattaataacacactaatataaaggtgaaatttagcttatctggtataaaaattatacaggaagcattgtcaaatataaaaaaaaatggtgtttggctttctttgatctaaaaactaataaaaataggtgctaaaggaaatttctcagtaagaaggcaccaagaactataaagtccactgctgatgtccccacatttaaaacaaatggtcattttcttagaaattatacacttggtttatcttccactttccttttcctcaaaactaaaagtcttttagcatatgtaccacccctagaatttctggcaaaccagcaccagcctgaagatcatgttctcatcaaagggtggaaagaaggaaaactcaagccagcctgggaaggacgctaccttgtgatgctaatcactgagactgctgttcatacagtgaaatggggatggactcatcacacctgagtcaagaaagcaccaccccctccagaatcatgggccgtagtcccaggggaaaccctaccaaactaaagctaagaaaaatttaactctttcatctattctattactctttaatctttcctcgctctattgctgaccatctacttattaacataacaaagtcaatttcgcctcaaactattgcatttaatgcttccctttttttttttttggtgttggggatttgctttttttatttatttctatttattattattatacttcaggttctagggtacatgtgcataacatgcaagtttgttacatatgtatacatgtgcctggttggcgtgctgcacccattaactcatcatttacattaggtaggtctcctaatgctatcctttccccctccccccaccccacgacaggccccagtgtgtgatgttccccttcctgtgtccaagtgtccttattgttcaattcccacctgtgagtgagaccatttggtgtttggttttctgtccttgcgatagtttgctgagaatgatggttcccagcttcatccatgtccctacaaaggacatgaactcatccttttttatggctgcatagtattccttggtgtatatgtgccacattttcttaatctagtcttgccttaatctagtgcttgccttgttataccctgtggggacttgccaagtcaaagacagctctctacttcagaagagtacctgtccctcctgactctcctcagactgggcattagtaaattaggaccatttaatccggggagatttcgataaagaccccagtgccaaccaggagtcttgcccccgatgtagagcttttatgccatagttggtccaatgttctgtggaccactaaagagcaaggatggactgccccaactggtttttgtaatttcctaaaatcatacattcattttactagaggatcatagaagttaaagactaaaacaaactttggcagttaagacaagataccaagatgcaaatgcccagttggaatggatcaaatattctgtccgcacgttaaacaaaagcaattgttatgcttgtgcacatggcaggccagaggcccagattgtcccctttccactaaggtggtccttcagtcgaccaggcgtggactgcatggtagctcttttccaggattctacagcctgcagtaataagacatgccaagctctctctctgctatatcccaaagttctgcaccctgcaggtcagcccctgagggccatccagcttccgtctcccaacactaagttcacttcatgtctctcaccacagggaggaaatttagcattccttggagacctgaagggatgcagtgagcttaagaattttcaagagcttatcagtcagtcagcccttgttcatccccgagtggatgtgtggtggtattgtggtggacctttactggacactctgctgaataactggagtggcacttgtgctttagtccaattggctatccctttcaccccagcatttcatcaaccagagggacggatccggttattggacggaagaatagccatgccacagctgctaggaaccgcagttgtactggctgtgcatgagaccacccacctaggcgaagagtcacttgaaaagttgttaggctggtactgtcagcctttgccaaaatggtggtgcagcagtgtgacacctgccagcagcacaatgctaggcaaggtccaaacgtcctgcctggcatacaagcttatggagtagccccctttgaagatctccaagtagacttcaccgagatgcccaaatgtggaggtaacaagtatttgctagttctagtgtgtacatactctgggtgggtggaggcctatccaacacgaactgagaaagcttgtgaagtaacccatgtgcttctctgagatctcattcctaggtttggagtgcccttatggatcagctcagacaatgggccggcatttgtggctgacttggtacaggagacagcaaaggtgattgagtgtggatcgaagactggaacatagcccccttgcggccacagtggaaaggaccccagactgtcatcttgaccactcccacagccataaaggtagagggaatcccagtctgggtccaccacagccacgtaaaacctgcagcacctgacacctgggaggcgagagcaagcctggacaacccctgcaaagtgactctgaagaagaggacaagccctgctccagtcacacctggaagctgactggtccacgcacgaccaaagcatgaggaaactcatcgtgggactcattttctttaaaatttggacttgtacagtaaggacttcaactgaccttcctcagactgaggactgttcccagtgtatacgtcaagtcaatgagataggacaaaaggttgctgcagtcctattattttatagttattatgaatgtactgggactctaaaaggaacttgtttgtataatgctactctgtacaagatatgtagcccaggaaatgaccagcctgatgtgtgctataacccatctgagccccctatgactactgtttttgaaataagattgaggactggcagctggggaaaagctgatacgagtaaagttgtaactggaacagaagagaaaggcatccccaaacaaattatcttaaaatttgatgcctgtgaggcaatcaacagtgacccatatggaaatagaataagacgtggttctctagattgggaaaggggctatatagtagaaaataagtatattgtcatgaattgagactgtgtagtgatgaatgtagttactgtgtcatttatgccacctggaaaaaaaaagatgagaaggaccctgtccaccttcaaaaaggaaggagtaactctttctgcactagtggtcactgtaacccattagaactactaattacctatccccttgatccccgttggaaaacaggagagtatgtaactctaggaatcaatggaactggactggatccccgagtaaatattttagtccaaggggaggtccacaggcactctcccaaaccagtgtttcagaccttttatgatgagctgaatctaccagcacccgagcttccaggtttctccagttggcagaaaatgtagctcactccctcaatgttacttcctgttatttatgttggggaaccactatgggagaccaatggccttggaaagcctgagagttggtgcctactgatacagttcctgacataattccagtccagaagtcctaaactagcaacttctgggtcttaaaaacatccattattggacaatactgcgtagctagagaaggaaaaaacttcactgtccctgaactgatccctaggctcagctgcctaggacaaaagctatataacagcatagcaaagatagtcacctggtggggcttaaaccatgctgaaaagaacccattcagtaagtttcctaagttgcaaactgtttaggcccatccagaatttcatcgggactggacggttcctgctggactgtgttgaatatgtgggcatacagcctacaccaaactacctgaccaatagacagggagttgtgtcatggtaccactaagccatcctctttcttgttacctgtaaagacaggtgagcttctaggtttccctgtctatgccccccgagaaaaaagaagcatagccgtaggtaattgaaaagatgatgaatggcccctgagagaatctttaacattatgggcctgctatctgggcagaagatggctcacaaggataccaaacccctaattacatgctcaactggatcatacagttgcaggccgttttagaaataatcagtaatgaaattggaaaggctttgactgtttcagcccagcaggaaacccaaatgagaaatgccatctatcagaataggttggccctagactacttgctagcagctgaaggaggagtttgtggaaaattcaatctcattaactgctgcttacagatagatgatcaaggacaggtagtcgaaagtatagccagtgaaatgtgaaaactagcacatgtaccagtaaaggtttggcatgggtttgatgctggatccctatttggaaagtggtttccagctctaggaggatttaaaactcttataataggtatagtaatagtgttaggaacctgcctattgctcctttgtttgtttctccaactactaagaagttttgttgccaccttcgttcatcagaaagctttagtgcaagtgtattacatgaatcactatcgatctgtctcacaggaagacctggatagtgaggatgagagtgagaactcccactagtgagtgaggttctcaaagtgaggaatgaggagagaggccatttctcttactgtctcctgtctccaaagaaaaggaggaagtaaaaactgaaaaataacagactgattgtctccactggccaggcctgtaggttaaagattaacctccatcctaatcgcttgtgctatctatagatcacagacaatagtatagagaaatacttgctcaatctatcactaccctgtcatgtggaccccttagagttgtaagcccttaaaagggccaggaactctttcttcggggagcttggttcttgagacgcaagtctgccgatgctcttggctgaataaaaccactttcttctttaacctggtgtctgaggggttttgtccacagctcatcctactacaataccatggttctgtgtcacaaaacattttgacattttccccttttcctcctgaccgctgtcttagcattcaactatctctggtctgcctagtgagttgcaatatatccttctcctttccatctataaaaattcccttgacaacatatctgctgccattccttttttattctttttgtcttttgaagtttgtttccctttccccccattactctcatcatagtcaattttaggagataaactcaatattgaattcactatgttaaaataaaagacactgttgtttttaataaaataaacttttaatgtgcttgatttttacttacgttgagagaatttataaaacattaagtatttatattttaattatatcatgaacatccccagactaactttgttaagcaaaataaaaagcaaaatacagtaaattaataatgatacctaccatatttttcttgagcaaaggaattccataaacatgagcaaatggttgaattgatgagaaaaataactactacctgcagtattcgattgtttctatttgtgtctagaaagtacatttgtcctgtgtaaaatccttgttgatattgcatggcagaagtaatgttctttgctatgggtctaggatgagactttggagtttcacaattttcagtacatgggcttttgaaatatgcacatggaggctgcaattctcattttctctgtccacatattttcagtcttctgttcccagaataaaattttccagactgcatcttcactgtaatatatgcccatgataaaaagaaaactctgcctctctgtggaataactcagccaaggaaattccatttttatgagaaagcctagtttgccttgagatggttgattgagttggaatctaaaagcagagtttctgataagcattgaaaagggaatatcacaacaatcctgtattattataatctgattctgaaataattacaatttgatattggtttgctgaagtaataattaagatatggatttatagcatactttacatttctcacaatattctcctctaagttgctaattttattctttctacagtactgagaagtgtaatatgtgacatcattcatgtacaacagatcaagtaacaattgagtgagatgctaactggcccacaggtcttcaagcaggagactaaagtctagaattcaggtcccttgaactgatttccacattcttttaactacatagctctggctgtcttttatatgtccagacacctcacatagtttcatccaagattgtcttctaagtttaacttgtgtaaaatattatattgttttataattactacaaatgccttttttttttgagacagagtctcactctcttgcccaggctggagtgcagtggcacaatcttggctcactgcaacctccaccacccagacttaagcgattcttctgcctcagcctcccaagcagctgggattacaggcatgcaccaccacacccagctaatttttgtatttttagtagagatgaggttcctccacattggccaggctggtcttaaactcctgaccttaggtgatccacccgcctcggcctcccaaagtgctgggattacaggtgtgagctactgcacccgctattactacaaatgtctttcaggtttcattattcttttgacatagaatccagtctctgtgtcattcgcttaatgtatgctttcttctagttagtaattgctagcaactaaactcttattcactatttatgtttctggaaaatctgaatgttaacctttaaggcattttttttgaggtgtgtgcatctatccctgtggtatacattctcggttttacgttctcgttccactatctcaattttttgatctgttaataccctgctacctccaagactctttgggtaaagagaacatagcaaaaaaagttgcaaaggaagtagagaatactttgacatagagagaaggctttgttcacaaggcagctgtttgggaaaacctctcaagctgttttccctctgctcccatgccacaacaatcaacacagaacatttctgtgactacatgtgtggaggtttttccccaaacatcaagcagcagacaccagctgggggtcctccgattcaattccaacgttatcatttggagatagtgtcagatcccacaggttgagggctcaagtacccaagatcactccagtttaagacaccagcccccttttgggtttgattaatttgctgggtggcatacagaactcagggaaacacatttactggtgtattataaaggatattagaaagaatatagataaagaaatgcatagggtgaggtatgggggaaggtgtgtggcacttgcatgtcctccccaggtgcacccctctccaggaacctccatgtgttcagctattcagaaactctccaaaccctgtccccttgggttttaacggagtctttgttacttaggcatgattgattaaaccactggccattggtatcaaccagaccttcagcccctcttccatctctggagcctgaggggtggggctgaaagtctttccagtgatcaatcatcatcctgaggctattagtcaatattagcatacaaaaacacagtacattggcgatttcaaggattttaggtattgtataccagaaaaagtggaggaagaacgaatatatatttcacaatgtattagtccattctcacactgctatgaagaaatacccaagactgggtaatttataaagcaaagaggtttaattgactcacagtttcgcattgctggggaggcctcaggaaatttacaatcatggcagaaagcaaaggggaagcaaggaaccttcttcacagggcagcaggacagagtatgtgcaagaaggggaatatgccagaggcttataaaaccatcagatctggtaagactcatttactatcacgagaacagcatgggggaaaccaccctcatgatccaattacctccacctggtaccacccttgacacttggggattatggggattacagttcaaagtgagatttgggtagggacacagagccaaaccatattacaccatatcacagtggcagtctgggcagttgtaggagagaccaggtaaaaggaaacttataacttcagcatgagatacacttatctagtggagggattgtctcccttcagcatgagatacacttatctgctggagggattgtctaatggaggtctgtaggtattgttgtgagacacagcgagacacagtcataccttacaacaataaggttccctaagagttatggagaatgaacaaaatggctccaaagtttttttggatgggttctaggggtatttgtgtatttcagaaacagatttctgagttcctgcagcactaaaagtaatccatatatgttgggaataatgctcaaaatcctaaggagattgaacactcaaacaaaggattcttagcaaagcaattttacttctgcacagaggggtgcttctccttggccagtaaccatgagagcacacctgaacaaaggggcacaaaagcctttattcctgacacaagtcctgtaccctttccccattggccggggtcgggtcacacaatctgaactaatcctggttggctagacatttgaattttctttagataaggtgggcacataagggacagaggggaataaaaagggaaggggtgtctgcaatgagctagagagctagtctcctttccaaataaggaaaggtacttgagctggtactgataagcctggtactgtggagtgtcctggcatgcaacaaaggcagaaaagggaaaaaggaaaaaagggtgtgtgtgggggtactacgaattaaagaataaaggattgatcagctatttgaagagaaacctcatcatatcccacagtatataattccaaatagttgactgtacaattttcagcaacataaataaatcattccattcttttctgatgctgaaaaatagacaggtttttagggcaagagacattgcgagacagagtagagacaagactcagtcctcaccaggatttggcccccatttttcctatacctgctgataaccagaccttgcagcaccagctcctgtggtgccatccccactgaccatgagaccttgaagaaactaagataagcagcatcccgctataagtcttactcaagggatttaactctattgccagcatgtgcacaagagcagaagaataactaaccaatctttatcccatgcctcattatgctactgaaatccccacccagcggatttattaggaggggcttatccaccattttttggtcatgtgatatatgtactaacatgatttctcactgcaactgtgtaccccgtgctccaccctgcacatgtaatgatgcttgcctatctcatgcatattcatgtcaccctttctaaagacactgcaaagacctgttcttagggagttagccagagaactatcatcccagtgctgcctcccttttgtttgagaagaatcccctagggaagctttgtctgggaaacttgcttagcctcgtgtcccttttgattacatgggagcctaagaatctgtggtcataaaaaatggaatcatctatgaatgcaatattttcaacacggtgttgaaaaatacaattgcaaaataacattgaaggggttaatattggtgcccactagattgatgtctcatacagtggaggggttcagctgcttgattcttggtaagtctatcgtaatcttgtctgacacctgccatgcaatttgtccatgcaacaaaagccctagttgaaaccagggcagaattcagcatgtgcaaagactgtcaccatctgattgtcagtagctatctcaggaccaacgaggagatcatgttgttggttggcaacaagactgatattgagaagtgagtgatatgctagaaactctttaagaaacttattgacctgtgatgatgagactaagatatgtcttttagcatagtggtggttgtgcaaacagtaagtcaagtataattgaaatggggcaaaatacacagtgagccagaaacactgaaaatatagataacaaagaaccccaggagtggtggaggatcagatagaatcaggcttctaatagaaggtgagatcattgggggcaggggcggaggggtgaatctaatagaaagaagctcatgggtaaatggagagagagaaggttggataaacttgctgagcttacaggagagaccggtagctgtcatgcaggcattgtatacatggagaggtgagatcagaggtctttgtaaaacaaaggattcttcaccttggcatcccagggccatatactcaccctcactgtgcccaaaggagaattcctctggaggccatatagattttcttttatttatttgtttgtttatttttgagacagagtcttgctctgttgcccaggctggagtgcagtggtgcaatctcagctcactgcaacctccacctcctgggctcgaggattttcctgcctcagcctcctgagtagttgggactacagacgcccgccaccacacctggctaatttttatatttttagtagagacggggtttcaccatgttagccaggatggtctcgatctcctgaccttgtgatccacccaccttggcctcccaaagtgctgggattacaggcgtgagccaccatgcccggcctagattttcaagaacctctacaactgtgtctttgggttgaaagatcataaacgaggaaaaacagtgtgtatgtataccttgtgcgggggtggatcctcagcatatctaatatagccttactcattgttcccttgtttcaatctatgttggtggggtagagtcttaatctgtttgggaggctaaaatagaataccatagactgaatagcttataaatcaaataattttattttctcacaattttggaagcttggaaatacaaaaccaagaaagcagcagatttgctgtctggtgagggcctgcttcttggtttatagatgattcttctcactgtgttcttgctgtgtccttgctgcagaagagaggaagcagctctctggggtctcttttataagggcactgattccattcataagggctctgccctcatgacctaaccacctgccaagggccctactcccacattgggagttaagatttcaaccaaaatgtctatgacaggtaggaatcataaaactaaatcataaaaataaaaataaaatagaacatatttagactgtttgtattcaacgtcaaagttaaaaattggtgtttgttatgtaccaaaacaaactgtaagaatttaaaaaaattggacgtctttcactttttaaattccatatttgccctgtgctaagtaaaacatgggcttgattaattaatttttaacttttttaagttaaaaaattaagactttatttccttgagaggataaaaattttaataagtgaattttgaaagggaaaatatctatacacttcaattttttgttcattttcttgtttttgttagtgtacactgaacatttaaaatcagcttcaggctaattgtggacattgccttattactttatatagccttgactgagagtgagtaatccattatgtcagataacatttattcttcctgtttcttagtttcctcaggtgtaaaataagaagattgattgacatgatagctaaggcattttctgaactattttccattctatgtacattgagttcatgctactcctaatgcatacataatcccttcatttcataaatatgctcctctctcagacctggattgctttatatttgttttttctttatctctgtacattttctatttataggcatgaggattctgtgatatgcatgttactacaacagcgtttttgttgttgttttttctctgatgcacaaatttaaaagcagctagcctatttacctcttttctgtttagcacttaggtccctcatgattaggttgaagtgaatttcttcatctgtcagtggcttttttagtctcaggacagacataacatttttacaatttacttgttttcacattcgatttgtacaatttgctccctcaatgcaaggactcaaatgatgctttacattttctgtttatttgtgtggaggtttggcccattatgcctgatggacttctaaaatcactcactaactcctacagaattctttgtgtctcttttttggaaatgtgaaaacttatctacccaagcaatgtgattattttctttgtgtttcttttctatttgtttttcctctctcaacacccaaagcaacttctctttgccacaatacttctgtttctcattttttgtcatattctgatttcttgagaaagaaatcttagtggaattgagaaatagcaatttggtttttgtttttctgtttgtttcttgacattctcctttctttcactttcatcagcacagacctttgttagagtgcatttacgtgcaagtttgttctgagaacattatttaataaagtcaggtatctggttctctgagaatgtgaagaaatacgagaggactattaaatgctgcaattaagaaaataggcaatgactgtgtactagtcagcttatatcagaaaggtgaatttcttgattcctattataactccttgttgctaatacttagaataaacaaaagggagaatggaaacagtttaaagaaggctggtaaagttagtaaatcttggttctgagtctttgattccttcctctggaccatgtccacatgtcccttatgcaatagatcagtttaaattcgtgaaataacagggtatatttttagcccattttgcattctgtatttcctttttgggcagtctcatagtcttaatgatgatcttttcttagtctggattatctgatcacaaggaactgataccaactcaaattatctatgaaaaaaattgtgaaaccagagaagaaccacatggaaaccaagtgcaaaaaggttagcttggctttatatgaactgcaacatccctaggtttcaattctctctgtcttttaagggattcttatactgcttttctgggtctgtcaccttcatttccctctcactctgcagtctaatttttttcttcctgtttttctatagcctttcagggccgctccaatatggagtattgctctcagacgaatgcaagaggaaacacttttgtgaggtgtgctgtctgttctcatcccccttctagtctagtctagatagctgggattctggaattctctaatctaccaggagtaattttcctcctcgggcacatctttctgagggcagcccacgcagccagtgtgtgcatccttgggcatcagcgttggcaatgggataggcatttgcaaggggtatttggatcttcgacatgtgagtgtgtggcagttgatttaaagacagagctctatgtagaacgagaagggatgccgatcatgatccagagcactagctagttctccgcattcttgctgggaatttcaaggattctgagaatactgtattcaaatctgtcatcataatggtgtagttgtcagcataggagtctagaacatatcttttaagcaatatattagtttcattttgtgattttgaaatatatgtatttgtggtatatggaattccatttgtatttctgtcctggaccccataaatataatgagggagttatgctaatgtggatatttacagaacattcccctataactgaattagtctttaattcacgtttaacgttatccggggtagaaactactttttcaaacttaagtgaggtgttcatgcatgagtctttcacagatatgtcaaactctattgtttaaagttaaattaattaccttccactcttaatgtactacccttacatttcatcctttcaacgtatttttattgaaaacccattctgaaccaggcactatgctagtcactggagaaaaaatggtgaacaaaaacatacgttgtccctattctgatgtagtggaagaaacaggttccatatttggtagacgggagcaccaccatctaccttgttatcaatcaccagatcttcaatttatacatgattttttctccctatgtatagccaattagttattaatccttgttcatctctttaattgtttttctatttcttcacattttgcttatccccactgccactgtcttaattccatcttaatttttcttctgtcacatagactcttgtttgggcttttttttttctttcttatctttagtattgtttttctcaaacacctacatatctaaaatggaaaactgtcattttacattcttgattataatccaatcatgttatgaggtagctcctgttccctaaatgccttcgctcacccatcctccaaaacaaatactaactccttatggaataaagtttaatttacctcgggaggaaatgccatctataaacagctttctacttaccttcttccatagaaaatgcttcccattttctaaatttgaatatttcatttcaacagcagcaatgtctgagttctgtaactttgctcccgatacctagaaaccctttctcaccaaaattttacctgttccaaactcatctacctctcacccaaaacacacacacaagtgtggttaggttccttttcaatgggcttttactgcaaacgcccacgcataagagtattagagcatctactgaaagtaatgaaatagtgtgcttacacacacacacccccttgtcgaataacacccttatacatattcattccattagattttaactactcaaggggaagcgctggttttatgataaagcagatcaacaataaatagattaaggaaatacataaaaagtttgataacttgtggtttctcagatttgacctatcaatgctccttttctctgttttcaagattgattttgttgcttttgttcatcttgtatctcctggtgtaaaacttttccagaggaaacacgtatctctcagagataaattctggagcaaatagttattgttttgaattcaggcagaataaaacagttcagagattttcactcacttacaccacactgaataaactctagcgactcatcctgaatatagagtggtataatatgtaaactcttcatcttcaaaagttttcagcctgcaatatgagaattttcattttaagtatctgaaggtaacccatattccaaggaagtttataccatcacaggaataaaggaacagtctagtgaaatagcctagttatgtgatatttactggctgaaattccaaatatactgtccccatggtgtatgccttcttccaggaacagctacattgggcaggctgtaggaatgattattggcatatctaacatttaagagttctttaggtgaattttaaattttatttatatgagttaagtaaatagcagcagaatgtattcatttaatgtgaccatttaaatccaagtagatattatagaccacaagttttgatatgtttttatttcctttcagttccaaatactttccaactctcctttgattttttttgaacttgacaatgggctactttaaagtgttacttcactttcaaatacttgaatattttcagatatgtttctgttaataatttctaatttaattatattgtggtaagagaacatattttgttttatttgaatttttataactttattaagatttattttttggttgaaaatatggtctattgtctcataatgtgctaaatactaggaatacacaaataaatgacatgaaaaattattaaacaattcataatcttttgtttaatagatatgtttacaaattataaatgcattacaaagaataaatgttataaataccagagatatgtgtacaaaattccatagaatattactgtggttttgtcagggagcaagttatgatctagaaagaatcatcattttattggtacttactgcagaacaggacacaggagagatgaatcatatttgtttcaaccttgggagttaatactgtttttctcatattacatataaggaaagattttggaattagtgaaaataggtcatagcataggatcagggaatagaatacatttaagaacttgatgagaaggtgtcattaaatctggaccaatagattttcttttttttttgaagacagggtcttgctctgtcacccaggctggagcggagtggcacaatctctgctcaccgcaacctctgcctcccgggttcaagcgattctcatgcctcagcctcccgatggaccaatcaaattttaaaaatatatcttcaaagacttatccagcaatttaaagatgtattcaccttaatttaaaattcatgtagatgaaaattttaattaaattttattgtattctattctgtcattagaccagaactcccttgttgagtactgacatacataatctaaatgagaggcaacttgtccaacttatgaaggactccatttcgtgaaagtttgaaactacatcttgaggtgtgtaccaattcacagcagcagatgtctgtatacgactgatatctccctaacaaggagtgtatagacaaagggccaggcagcctctggataataatattattttgtctttattgagcatttatctctgaggaactaaagtgatttacaggaattatctcattagttcatacaatattcttatgaagcaggtagatgacagctgatgttgtctttgttttttaatagaattctctaggtacagcctgggaactttgattagataagtgagctggatccataatatcctaatcaaagggaaactgtctttccaactttgaaaacataacattcaaaacacatttttgtaagtattgaagttttcagtgtatattccagctaaaggagcaagccatatctaaaggtgttattgataagacacattcttaagaactcagaagtgtatagattctctatgaaatccaacaaatatatttgaaaaatgtgctatatgagaaataaaattagagcatggtattttctgtagagaggttttgtcatcttggtaaggtaaaatttatgaacataaaaaagtccttactaaggacttcttataggatatctataattacatatgtgtgatatccttaatcacacacatatatgtatatagacacgtctatgtatatctgcgtatatccctatattcaacaaggaagttctggtctaacaatagaatacaataaatgataataaatgatagaatacaatacaatagagtataatataataaatgatagaatacaataaaatttaattaaaattttcatctacattaattttaaattaagataaactaagtcttcaaattgttggatatgtctttgaagatgtatgttttaaattctattggtctagatttaataacaccttctcaccatcaagctcttaaatttatttcctgatcctatgacctatcttcaccaattccaatatccttgatcagacacatgtaactatatagatatccatccgtatctatgtatatctctatctctgcttcaatatctatctatctatcatctaaaatgaaatgccaaaataaatataatatggcatacacaaacttgttctctcttagaaatggatagaacactatcagcagataattgtaatgaaagattgattataaacatagctgcctattgcactttaaataaaatgcagatgtcttgctgtggcctttaaggctctatgtggactgccttgattatctattcaacctcatcaaatagagaactatttcttatttggcctgtccccaaacatctaactcctctgcctgcattctcagtttcagctgatgaccttggattctatttcactaagaaaatagaaacactcagtagagcatttccacaagctgttttgaccatatttacagacttaacctcatctgttttcatagaccctggctctctgcctccctatggatgaactgtctgtaatttatctcagttgctttcccccaaatcactgtgtactatatcctgtcccctctagcccactcaaggctatgctgcaggaacattcctttcttctgatttatcattttccttctctagtaaatcagtaggcaaacatgatcttacttcttccattgaagaaaagatattcttttttgttgttatgctctttactctttacaggttctcaatatttatacacctttttgctgagtgcagggaaaataaacataatttgttgagtcaagatataatttataattaattaattaatttttaaacttttattttaggctcagtggtacatgtgcgggtttgttacataggtaaacttgtgccatgggggtttgttatatagattatttcatcactcaggtattaagcccattacccaatagttgtattttctgctcctctccttcctcctaccctctgctctcaggtagaccacagtgtatgttgtttccttctttgtgttcatgagttttcatcatttagctcccacttataagtaagaacatgtggtatttggttttcctttcctgcatttgtttgttaaggataatgtcctctagctccatccatattctctcaaaagacatgatcttgttttttttatgcctgcactgtattccatggtgtatatgtaccatattttctttatctaatctgtcattgatgggcattcaggttgattccttgcctttgctattgtgaatagtggtgcaatgaacatgtatctttatggtagaatgatttatgggattgctgggtcgaatgatggttctgcttttagctctttgagaaattgccacactgttttccacaatagttgaactaatttacactcccaacaatgtataggtgttcccttttctctgcaaactcaccagcatccattaattttttactttttcataatagccattctgactggtgtgagatggtatctccaggcagttttgatttgcatttctttaaggatgagtgatgttgagctttttttcatatgcttgttggttgcatgtatgtcttcttttgaaaagtgtctgttcatgtcctttgcccaccttttaatggggttgtttttctcttgtaaatttgtttaagttgcttatagatgctggctattagacctttgtctgatgcatagtttgcaaatatattctcccatgctgtaagttgtctgtttactcttttgatagtttctttcgatgtgtagaagctctttagtttaattagatgccactagtcaattttttgcttttgttacgattgcttttggtgtctttgtcatgaaatctttgcctgttcatatgtccaggatggtgttgcttaggttgtcttccagggtttttataccttggggttttacatttaagtctctaatccatcttgagttggtttttgtaacagtgtaaagaagaggtccagcttcaataaattgtgctgggataagaaagtattctttattctagagacattctaattaccctttttagctattttgaaatatacaatagattattataaactatagtcaccctactgatttatcatacacaaggtcttaggtcttctatcatattgtatgtttgtactcattaatcaatctcttttcatcccctctgccccactgttgttcctggcctctggtacccaccaatctactctctgtcttaatgaaatctacctacatgtaagtgacaatatgtgatattaatctttgtgtcctttgcttatttcacttaacataatgacttgcagttccatcaatgttgctgcaaatgacagatttttattattttttatagcataaagaaaatacaaatatttaaggtgatgatatcccagtcacactgatttgatccttacgaattacatgaacatattaaattactgcatgtaccttaagatatgaatttctattatacatcaatacaaaattaaatctaaaaaaagaaagtatttttaatgttactgactcatttctctttttgtttctataatgaaaatcttccagagagttgattgtaccatcagtttctaactgttttctactctccaattctccctttaggcttctctgtgcaaattcaggttttaaggttagcagtgactcacacattactaaatccagtgaccagtcctcagtcctcttctttgttgacctatcaacaacattagactaggttgataattccttactccttaagacattttattcactggctttcttcccctgattttcctcctatagttgtttggtttggtcttccttgcagttttctcttgattgttcagttcatttcatattagtgtggtgggatcggtgattcatttttcattacattaaaacataatgaaactattcactgtttctagcctattaacaaaccaaacttggtttgctttgatattgtggttacaggtttgttttagtgtaaatagcttacaatgtgaactattggaaaagatcaaagaggactgagtcaaaacaggaaagcagatgacctaacggaattgaatatactcatccatcatcatagagttagactcactggttacttctggcttttttcttcaacacaattcagcttaaaatggacagagagggaagggcccccctcccgccccacttagatgctacaccagctgacagaggaatttctagagcaatttaaaaatacgagtgctctagtaattccaaaacactgtcctcaaacatctgtacaggtgaactctggtcacaggtgtgtagggagacctgagtgattgggagtcatcacttgggcggtggtaagtttgcacctctctaatttcactgttgggagtagctgcagaagctctacagagaggctaaatttgggtgagtgcaatctcaaaggaaaacaaaataatgaaaacatcctagagtttgagagagggatcagaactctaaatactgatttagggctaccagcttataaaagtaagcactggagtttgaagtgaagatgagctcacccaaggcaaagaccacacagttttcagcatacttaaggaatacagggaagaataagagggaataggcaagtactcaatatggcaagtgtttggagagcttttgcatatcatgatcaaaactataaagctgctggttgtggtggtgtgcacctgtgcacctgtggtcccagctgcttgggaggctgacgtaggagaagagtttgtatgcagcctggcaacatagagagaaccaatctctaaaaacaaacagacaaaatacacaaaaaaccatatttccaaccaaagcaaacacaacctctgccttacacttgaatagcttattttattttattaatctttttctttacagtcagggaaaactctgcctcaaacctgaagaattggactttgaatttatgttccttcaggggtccttaggaatagttcttaaactttacaaggccacaaactcattgaaaatttaatgaaacctatggatccttccccagaaaaacaaaaatgagtgtaaagaaacagacatacctctgaaaaaggaaattagaggcctcttgggtgctggtaatagtcacagagaaagagatggctggtaatttcttgtgttcggttcgagatgtttttctgctgctttcttattatattcacttgagattttgttgttatgataaaacagtactgaactcctagttagggttgctaagttttattttccaattttatcactgccttttgtaattgtgtcacatacatgctttctcttaattaaacataacgctatttatgctacctatgttctattttggagagaatagaacatgttgagttggagcaacatacctacaaactggtaaaatgaacaacatacctacaaaccggtaaaatgaacttgacagtagaattgaaccaagctgcctttcctagataatttaaattagagggagtaaattgctcttaaagcttcagacagagtttacatgtaagtaaagaacattttttatttaacaaagtaccttttataaggtttaataaagattttaaagtagcaaatttgctttacatctccttttacatataagactaagagacaaacacaattcagcctgtttttaggtaagatatgcaacgatgtataaagtaagtacagaaagaggaattctgttttagatggcagtagcaaagggggaaaaagcagagggaaatatgaggtcaagggtaatggcaagattcaggtaagcgtaggtaaattgaaaatttgatctgaacatctaacattgattgacagtgttttagacacaggagccagacatcatttactgcagactcaatagaagtcaaagattaacttccttgataaaaagagccacaaatattgcagcaattaaatctattaaaatattacaagttagccaagtttaagatagatattggttataagggtaatataaagaatcacaaagacaaattagcatgatctaaaatgttgtcactctgactccaggtcttaatacaggatgttggccacctgagtgacaaatttgatatagcaaaagtagaaagatacctgtaaacaaatgagttcaaaggataaaattatctttctagaaactgaaggcatagatggtgctattttctataactctgtaaaatttttccatttttgtatcttgtgttctctctttgtgtatatgcgtatataaacacatatatagtagtaaattctatagtcgcttgagttattcctatattttttcttgaacattttcataccaatatcagtagttgcatacaatttatatgctgtttaaaaagcagacatagtagctacacaaattaaaatgagcttatacctagtctttgaaggaaatgatacatgtctcctttactttaaatatccgataagtttatctaccatcatttactcatatacacatcttaaggttgtggtagcagaaaatcatgttagctcaacatggtcaacaaaaatagagatgatgtaggaataacagtaaaagactctgtgggaaaattatctgtgacagtgtaatcatccattaagacatgggcccggagtatagcacagatgggcagatagaatatgctccctttggggagattcaatagctgtgtgaataatcaatccaggattattagtcctggcttcatatttcatataaaatcttggataaaaattgcctataagccaggtgcagtggctcatgcctgaaatcccagcactttgggaggccgaagcaggaagatcacttgagcacaggagctcaagattagcctggcaaacgtagtgagataccatctctacaaaaaataaacaaagttagctgggcatggtgtcatacacctgtagtcccagcgacttgggacactgagccaggaggattgcttgagcccaagaacttgaggctacagtgagccatgattgcaccactgcactccagcctgggtaacagagtaagattctgcctctaaaaaataagaaaaaatatatctgtaattgtaaataaatgtaattaaataataaaacacaggctaaaaataaaaaataacgcatttattgtacagaactttctaatgagcatttaaactgaaaactgttttataagaaagcacagaaaaattactcatacatttacagactgttttctatttattaatatctttgttccactttaaagctattttccggaaagaaagtattcattattcaattaaatttttacagttcaaatgtttatatgcattttgacattcttatactgtaaccaagtaacaattaatttgattaatgtttaaaaatgtttaaggaaaattaatttagtatgtattgaaactaattttattttaaataagcatggacatgtcccataaacttccagatacacatgtcctaaagatatagcagaatgtgtattaccaaaggaaaagttgttggtgccatttttttttaaacggagtctcattgtcgcccaggctggagtgcagtggtgcaatctcggctcactgcaacctctgcctcccaggttcaagtgattctcctgcctcagcctcctgaatagctgagattacaggtgcccatcatcatgcccggctaatttttgtattttttgtattttagaagagacaagtttttgccatgttggccaggctggtctcgaactcctgacctcaggtgatctgcccacctcggccttccgaagtgctcagattccaggcgtgagccaccgcgcccggcccgcatctgtgccaattttagaaaataatatacatgtatttacttactaggtatcttcacctgtatgtctcccacatacctgagactaagttcttagccaatgtcattatttcttccctaaatctataattatacctgtttatttgactttgttagtggcacaggtatgtatccttccagagaacaatgcatcatcttcagttactccaacttacagcaaattactcagactttacccttgtccgtcactcagataataatttcagtcatctaccaagtgtttccctagtctatgatttcctcttccttcaatccagtatctatacttttatgacaattcactttgtaaaatgcaactttgacctattagtaccttaatttcagcctctcgatgacctcttcctgtccacagaatagaatcgggctctttaatagagcacgagagtcccttcatgatgtgacacctgcttttgcttccaggtgcattccttttactctgcttcacactttgcatcgtaacagcattacaagatgctcatttctctgtcatcacaccaataacatacacttacagttttctctttggaatgctgcctctccttgactggctattaaactaaggcacagtatttcaaatccaagttgaatgataaaaataaaatagaacaactatgaatgtatccctcctatgatgctttcttttcccctgaacaggccattttgaccccaagattgaattatttacctcttccttgctattttgttagttcatgcatattattaatgcttctccagtttcacttggtatattttaattattatttatatgtctagttttttaaaagaaggtaagcttctctgtggaaggtaatgtgtcttccattcttgtaacttgcattcagtttcaacgtgattgtaaagcctacttacagtcactgacttccaggcttgtctcatccagccttccatttaatgggatccactttgaggccatttgaaatgacacgtttgagtggtaagacaatctttttaatcatgtaaaacctaatataaagcataattataaataaaattagaaatactcacatatgcttcagtgtcttattgagaatatgttattgacattggatgaccatatgtgcaatttcagtagctggaggaagcatacaccagctggtctgtgtcattgtgcttattgggaatattacttttatagtggtaagtactataaatttgactttattaattttttattagattgctattcataaaatttgtctgtataccagatggtacaaattgatctcaatgtacccactggtataatgtatagctctgtaaaaaacagcacgagttttgctgctaatctctcttaatgaaactagaatgatgtctgtcacatatttttctttctaaaaattctattaaatctaaccctttcaccgatggtggatcagttaccttgatcatccttcatgcttactatgactttgaaataatctgaaactctggctttaatcaactgtagcaatttggattgattatgaagcagagatgaattcagtcatctatttagtgtattagatattaaaatgtgaatgttatgccagttttgggactgcaagcatatcatgaaatacatggatataatatccaaaggagtagtcagtattgatgaggtattttatggcttcaacctgtagccttctcaatgtaatcagagtaggaacttttctacacttgaattcattgcatacccacttgtattctggttgacattggttaccatgattacaaagagcaactcatccacagtatacatttgtttgtgagtgtatcatgtactgcttaggttttcaccaaaaaatgtgacttaacttttcttcatattctctgccttcagtaaaacatatcttgtatccttttatgataaatattcacaaaccaatacatgttgtattttttgtactcagttgtggtgctccaatgtttatgtgaaagctgttaattcaacaattcttcaaagagctgggtcagtccctttggctcagttctactctctcacataggcattctagtttgtcaatgctccttttaaaaatttggcccaaagttcaaaacacaatattctgttgcagagtcagaggactgaccattgctttgttgttgttgttggacatgcatttatatatcaatgccttctaaaatcacatgaacctttatggcaactatgtgacacatatgacttgctgagctaagaaggaacaaaatgtttagaccaggtgcagtgactcacgtctgtaatcccagcactttgggaggccaagatgggagaaacgctggagcccaggagttcgagaccagcctgagcaacatagcaagactacatccctaccaaaaacatgtaaaaaattagccaggtgggttggtgcatgcctatagtcccagctactcaggaggctaaggtggggtgattgcttgagctccagagttcgagactgcagtgagttatgatcacaccactgcacttcaggctgggtgacacagtaagaccctgtctcaaaaaaaaagtttatttatttattttttggtatgtcctaccattcatgcacatttctctcatactacaatttttcttttggtgtaatgtaagatttagaatgtaagccaaaaataaaattctaaagcttccaaccatctaaatagacttcctcctcagccagggctctgttaaaatttaatctgaaaggaccgggagcggtggctcacgcctgtaatcccagcactttgggaagccgagaggggcggatcacgaggtcaggagatagagaccatcctggctaacacggtaaaaccccgtctctagaaaatacaaaaaaatagccggggcatggtggcggatgcctgtagtcccagtactcgggaggctgaggcaggagaatggggtcaacccgggaggcggagcttgcaatgagccgagatcgcgccactgcactccagcctgggcgtcggagtgagactccgtttcgacaacaacaacaaattaacctgaaagactggttcaggccatgacgggaagtgggggtcagacatgcctcatcatacctatctggcattaacatcaacacagactttaagtctgaaatgaaacattttacaacctgttctctctgaagcctgttacttggaggcttcatctgcatgacaaaactttgatctccaggacatcttcttgcaaccgagacattcctttctattgatcccaggtctttggataaactcaaccaattgttaaccagaaaatttttaaatctacctataagctggaagctcccccatcaagttgtcctgcctttctggaccaaaccaatgtatttcttaagtgtatttgatcaaagtctcatgcctctctaaattgtataaaaccaagttgcaccctgactaccttgactaccttgggccacatgttctcaggatgccctgagtgctgcgtcatgggccatggtcactcatatttggttcagaataaatctcttcaaatactttacagagtttgactgttttcattgagaaaaattattatttgttttcttttgttagactaggttcatatttcacccatctaaatctatttgtttattaaagtgtaaaaattgaggagaggaatggtgaggtaggccaactctttgttaaggcagtagatgatataggttaaatctcccattgaaactgaagctttttctcttgctcataagatttttatctgacgagagatagagaaaaatcatggctttaccctttggtcctgtctggtttggaggacatcccctgagcccaacttggcttttacactactcgtggtaggttttttcctctcgggcttaagctataatgacatgtttaatttttttaaatgcagttcaaaagggagtatgcttgtgctcctcctcttggtgtctgccttaaaggagcttttcctctgaagctgggcagtgatctcactcaacctggcatcagagcacggtgggcttctttcctcagtctttttgccaatgtcccagcctcacttttgggcagataaaaggatgaataaatttaaatggtaaatgtgatcggtctaggcctgatacttctgagctcgcttttacatttaaatatggctgtgttcttagaaattcagaatccaagaggcttttaaaaatcctcttctggtcgggctcggtggctcacgcctgtaatcccagcactttgggaggccgaggcgggcggatcacgaggtcaggagattgagaccatcctggctaacacggtgaaaccccgtctctactaaaaatacaaaaaagtagccgggcgcggtggtgggtgcctgtagtcccagctcctcgggaggctgaggcaggagaatggcgtgaacctgggaggcggagcttgcagtgagccgagatcgcgccactgcagttcggcctgggcaaaagagcgagactccgtctcaaaaaacaaacaaacaagcaagcaaacaaacaaacaaacaaaaatcctcttccatggccctcctttcataagcattcttgttaacaaagttcagcattgactctcgtttaaaatgttaaggtaatttaatgttgtctttttaactcagccttatcataattcactggaattatttttgaaaacaacatttatagatgaaaatccatctcactttaaatagctcacaagactatagctacatcctcgagatgactgagtccgaagtctactctggaattttgagtctatgatgcagacaatgggttgtactaagttttttagacatcccggacaaatctctgtctctgggaggcttgacactaaatacgaaataaaaaattcagctgtgtaaaaaagataacatcattttcttataaatgaaaataaattcctatagtgatgttattttacagggtagttaaaactagactaattcagtgttctactccatttcgcctggaggtgtttcacgttctttcttattccgtagcattgctgagaaggtatcacctgtgtggataaccattaagctcctctagcctatttctcctgggcatcttgctgtctcctggactttacctgcaaagaaaatacagttttcctccattctagaattcctatatctcttctcttgccctctggagaatatcctgtttccatcaccttcatttcctctgaactatgccacagatgcaagaccctgctctccccaggacccacgctgtccactcagctctttcttctttcttgatactcttcttttctctatccttccaggcaaggggaactttgtgttgttttttgatattggcagttttgagcagaaagttgttctccttatcataatgtaaagttgccattcatcattcaaatttattctcctgagatctaggcttttgaatctcgaaagttaagaactgttgttttagctttatcatctttctgatgtgtcaacacttttatgagtcaaaaacacaaagaatgccctatagactgcctaaatagaaaaaaataaaacatactggctaatccatcaaaatattattctgttgcagatatatgatgaatatacatatgtacatacatatatgtgcctatgtatgtaaccttgcaaaattcggatgttgtctgccagttctaatgaaaacataacctgatttaaatgtgttgttgagtttctaaggttctactctcaccaagaaagagtagtaaaatactgccaaatttgtttacagattgcaatcatttaataatgcaaccaatatgccctatttccaatttcacttttgaggcactaaagaagataatgtattttaaaatatcaaattcagtgactctgagacaatatatcattcttagaatgaaaaatatgttttttctcccacattctcccccccacccaggaatagtagaaacacgaaaaatacacacaggtttcatgaatcactcctgcttagtgctggtcaccaccatcacttaatggagggcatggtgaatccgctgcgcccctaaaagctactttcccaaatggcagaattctgtgaactctcctactgctcttggtttctttcagaattgttcattgctgtaatcttctaaatatgccattaccttgcaaatacaactgtgcaggaggtctgaagaatattccctccctccagccactgctgtggtaggtaaagcatggcatattctaaataccagagcagtccaggtatccactgaatattctatacgaggagaaatggcagcttttccagatgttaaaaaattagtttgtggtgttatacgtcaagtggctggctcttttctatgtatacacatctagtcatttgccagtggcacatcttcaatgccaatagtattggaccacagaggattcagtatcaatgcatgcttttaccagagccagctcttccccatttgaatcttcaaaagaagaagcactgtcttctctccatctcagggcctaatgcattttctttctgcaagactcatcactttctagagtgaccagtattttacctatttccacaggtaaaacaaagaaaaaaataacagtcataaaactgttattatagtttatcttattgaaaaagaccaaatagttgaaccaatatgaattaggcctaatttttcataattaggtctcagagtcaaggcgtcatgagaagtataccctaactctaaagacaaacttgagacagaggaactggtgagaaaagggccttgctgttgatatcaggaaaaatgagaattgggtgctgtgagatgatttgattgtggggttgtgtgttgctttgagacaagatttatcacacggcatacacatttgaacatcaccgataatgggcctcatcctagttaagctatagtctgagaagaatcactagcatctaagccaccagccatatctactcctggagaaaaccttatgataggggaacactggttgatgctatcagctcctttttattaatgctgtgtacaactagtggtctctgttctttccagtatctgacatgagatctcaatttgatcagcttatgtgtggacaagggaggcttatgataaattgtttctatttgcccttaatttcttaggctattctattagatggcagagatctaatattactggctctttgtgggaccatgctgcctcctgttgatcacagtttcattttctgcagacaaaatgctagctaaacttggcccagttttatgttctcctcatcttgactgtgtaaagcttcaggaaattttctttttagaccttacgtttaatttaataaataacatggaaattggctgttgtaaaaatatttggtgattttattttgatatggcacattttgatttatggtataattaggtatcagtgaaacctcaataattttattaaaaatatttaagcaaggctatttcaaattttgtgcatttactgatttcattttgtagaagacagtgatcacttttaccttaaaaattatttctagagaaataattcaatttctttacttttcaaagtcttacatctcttgtcatcatgaaggtgcatcccattatcaaaagctttccagaatattgagtttttgttaatttatagaataaacaaatttataacaacaatatgtaatgttaattcactgtatttaatttgtaaaaattacgccttagttcattgttctttaataattgtgtctgctgatgcaatatcatatatcactattaggtggatataatgaaaatcaataaatatgtgttattaattgaagaaatttatagaatatgttgatatatatacttaggccaactatactgtaaactcaaagcacactaatagtatttaatcctagtttttatatactacattaattctgtgttatcattttatatatgtattttatgtagtatatacttaatatattaatttaatatattaagcttttaatagcacttctgctcctaataaaatagtaaaataagaagaatattgtaataaatttacttattcagcagattttatgatgttataataaggaaaagaatgaaatatatttccttaacaacttcataataaatgccaagaactgtattatggagcaaaaatataacttatttgccttaattcaaagccaacattctttatgaagtgaattagaaagaaagactaaatttttgtcgggatacttctttcatcatagatagaatgataatttcagtaatcattcaatataagtttattaaaatgctctgccataaaataatctttattctgaatggaattagctgtcttgtgaatcatgaaatatatacaaaactaagttaataaacactctgattctatctagactaccaaattcccatttaatattttcaaaatcattgtatattaaagtgatcttttgatagaatcaaaatgttcctccacttgacagtgtccttaacacaataagtaaatcactttatatactagatttgatacaacattaaatgatttgtagttgcatggtgaggagaatgcagtggctccaggcataacgtaaggaacatggagattgtatgcttccactgaatttctaatctataagtttactttttctatttaaagtttttttaaccagaagataaattattggacattttgaatgttcccagtaattgaacttaaattgaatacagaaaaacaatattcagaaatattatacacatcagttttaattatctaccaaataataatgttaatttagaaaataccgtgataaaaacagaacctgtcctagtttacttacaaaatattaaagtatttttattaaaaattcttataaaggtaactaaacctttaacctcagactggaaaagtattttctctgctattaaataaggagtgcaaaataagtttcatttttttatctttgtattagatactgtccagttacactgacttcatggaaggaatggagaaaatccatagccaaaaaaaaaaaaacctcaaaaaacaaaaacaaaacacacacatacacatgaaacttgatgttatgtagccccttttcactttgattattcttgtaataaagaagatattagattctaaaagcaaaaattaatttaaaaaattaataaaacccctcctcatactttcagagaaagaaaattgttttcaaagcaggcagtctgtgaggtcttgtatgtttttattgcgccaaatagatggcttcacccttttcaagattttagtgaacctttgctgacaggagctcttagttgttgtcattccccgcccctcgttcccaaatatctagactgtaaaatttgattccagcctgtcaaccattaagcagcaataattatttctgaagtagtgaaggtgaagtgtgacagccatttcatatcgacgaccttttccaagcttcataaaactttcaggtttctttttctttctctatctcttatgcaacagccaaagagaaaagaaagctaaggaaaacagaacctagtttttcttatgtgctgcatgtttttgtttgtttgcaccaaactatccttttaaaactagacttggtaataataagcaaaaactgaaacacaatttatagtttcccaggctctttaaacatgattgtgatacgtggtcgcccttaataagagcactggtcttagtttatttaaaacaacaaccacaaaacctgtagtttagtttgcagaataattattgaagataaatttcacggattgtggagagcatcatattactgctgccgtgtggccttaacttctattatataattggttaaccatggaaggtacatttgttgacattatttagagagatgttattaattcagttaaactggtaaaaaaaattctgctctttaagagtttttagttagaaataacactgcaaatttttattattttctttaaagacatactttgtattattagaccagtatttctaaaagtagataaacagactttagaatggcttgaactgatgttaaaaatgcacattcctgagttcagtcttccaaatcagaaagtgggaggccaagaggactacagcatttacattttgataagacttaatatctccatcccttattgtgatgctaatgtacactaaagtttggaaactattgatttagacataactcagaagccatgttttaatagtcttaggaaaaacaagccatgttagatcaatttcttttccttttaaattgaaataataagctttgtaaaagggggtaagatggttttaatttttattgtataagtttagaaaaatgtatcctggaaacatgaagaatggattgctatggtctgaatgtttgtgtctccccaaaattcatatgttgaacccccaacccccaaggtgatgtattagccttttggaaggtgattaagtcaagggagtgtggtctcataaatgggatttatacccttacagaaaaggctccagtgagctcctttgcttcttccaccatgtgaggattcagcaagaggatgccatctataaatcaggaaatgggccatcaccgtataccaaatatgctggcaccttgatcttgtgctttcagctaccagaactgtgagcaataaatttctgtttttgatatactccccagtttatgatatttcgttatatcagtccaaagggactaagacatggatcctacctgtggaatctacgtgatcattccaactgtataatttgcttttgtgttcccactagaaagacatagtgcttagagtgtacctggaatattgatacacaatttgcaaaggagggatcagcatgcatagttctttataggccgtggtgtgaactgaggtttttcttccgtataagatgagaagccataagagtgttttaaacagaagagtggagtacaatttacttgtgctttagaaattcacacagaacaaaaaagagcccaacagcccaaatagccatagcaatcctaagcaaaaagagcaaagccaaaggtatcacactccctgatttcaaactgtagtacaagtccaatgtaactcatacaaaaatagacacatacaccaatggaacaggttagaaagtccagaaataaagttatacgcctacaaccatctgatcttcaacaaagttgacaataaagagcaatgggggaaaggactctctgtttaataaatggtactgggaaaacaggctagccatatgcagaagattgaagctggaccccttccttacaccagacacaaaaatcaacagaagatggattaaagacttaaatgtaagaactaaaactataaaaacactaaaagaaaacctagaacatatcatactggacataggccttggcaaagatttcatgacaaagtctctaaaagcaattgaaacaggaacaaatattgacaaagtggaccttattaaactaaagaacttctgcgcaccaaaagaaactatcaagagagtaaacagacaacctacagaatgagagaaaatatttgcaaactatacatatgacaaaggtctactatccagaatctataaagaatgtaaaatatgtaaaatcaacaagcaaaaatcaaacaaccccattaaaagatgggcaaaggaaatgaacagacacttctgaaaagaagacaaacacatggccaacaagcatatgacaaaagacatcactaattactaggaaaacgcaaatcaaatcgtgagatatcatctcataccagtcaggatggatattaataaaagtcataaaataacatgttgatgagaaaagaaacatgtcagggagaaaagaaacacttatacactcctggtggaaacttacactaatgtaaatttgttcacactgttggtgaactaatttatattagttcatccactgtgaaaagtagtatagcaatttctcaaagaagttaaaacaactaccattcaacccagccatcccattactgggtatatacccaagtaatataaattgttctaccaaaagacacatgtgcttatatgttcatcacagtattagtcacaatagcaaagagatagaatcaaccaagatgcccatcagcagtggcctggataaagaaaatgtggtacataaataccatggaatactctgcagccaaaaagggaaaacaatgtcctttgcagcaacatggaggcagctggaatccattatcctaagtgaattaacaaagacaacaacagaaaatcaaatgccatatgttctcaattataagtgggaagtaaacattgagtacgtatggacacaaagaggagaacaatggacagagatgcctacttgaggggggaaggtgaaaggagggtaagggttgaaaaactacttctcaggtactatgcttagtacctgggtgggtgatgaaattatttgtacaccaaaccccagtgacaatgaaaattacccatgtaataaacctgcatgtgtacctcctgaaatgaaaataaaaattggagaagaaaaataaaaagaccattttgtattgagtggagaatagattgtgtttggtaagaatgcaggcaggaacagctaatacaacagaccaggtcagacgttgtaatgatttgactagtgtggaagtgcctagttgctgaaaagaaggaggatcctgaatgtatttcaaagattcagctgacaggattagatttagaatgtaaaaggaaatgtgacaaataaaggaaaattacaacatttttggcatgtgcaaccaaacaaacaggatttactaagatgtggagttgttagtctgttctcactctgctaataaagacatacccaggttataaagaaaaataggtgaaatggactcacagttccacatggctggggaggcctcacaatcatggcagaaggtgaaggaggagcaaaggcacatcttacatggtggcaggcaagagaagtgccaagcagaaagggggaaagttccttataaaaccatcagatctcctgagaacttactgactgtcataataacaggatgggggaaactgcctccatgatttagttatctccacctggtccctcccatgacatgtggggattatgagaactacaattcaagatgagatttgggtggggacacagccaaaccatattaggaaccttgtatattagggagtttggagaactctgtttttgggatggaaaaataggagattctagggttctgttttagacatgctaaatttggagtcttcatcaccagatcatggcccgcaaactattatccatgagccaaatatggcttattgattgtctttgtaggacccacaggctaagaatggtgttcacgtttttaaatagttgaaaaataaataatattttgtgacatgcataatttacttgaaattaaaattcctacatgcataaacagtcacactcatttggttgtattgtatctgtggctgctcttgtattacagaggcagagctgagttgtgcaacagtgaccatatatttcacagaattgaaattgtttagctgaccttttatggaaaaatttcctgagcccttattttgatggtctaccacaaacaacatgctagcttgaactgtaggaaagttaggcggcagcttctgcattactctaatcaataaatggcccaatttttgctcatgtaaagaccttagtcatgagaagatttaacatgcatgtgacttttcatgtgaacttcagtgccataaccaacagtaaattacttgtggcaagtattaatcaacttctatctggccaagagaggagatgccacttcataaagacatcttttgaattccccaaagtggatcacgtggcttctggtttattttacccaagcaggagctttcctagtcaggaatgaccacagtttcacacaccgcttgatgtatctgttatgctgtgcatctctaaggttaggtggaatcataggagtatattataggaaggtttttccactatcttgagacatgccaaggacaaaggaaaaaaatcaatactttatttctattaaattatacattcaacttcctataacctctaactacagtgaaggaactgagtcctctacttttagaaaacagtcatgatattgctattattaaaacaaaaaaccttctattgctctaactaaataaggttgataatttagaaaattgagagataatctgcatttgatgagagctgagctcaagttgtatgtgtacatgtaggagggtcagtattcaaggccacagataaatgcaccaatgtctgattttcactgaatttattataacactatttttagatattcactagttttatatatacagaattgctttattatacatacatgaaaaactttaaaatatgttcaatatgtgaaaagacatttactttaaaacctttatacctagtggagctttttccctttctataaaaagagacatatgggaggagaaatcatcaaatccctagcaggaagttaatacccgctgagctcctctgacagaggcaagactcctctaaagccttataagtatgtgagatccagtcttcataaaaatgagtcagggtttgctctgtgacaggtaaaatcttccatttctgaagttatttttaactttagaacataatttctgtgaattttgtgctattaaaccttcttcctactatttaagcatgtaagattttttgaaaggatctagtatactatttgccttttgaatatttgatgacatgctgtatgggaaaaatacacaaacatccatcaccattttttttattttactttcatcttggcagtattacatatgattggataacatcaaatgtatgtatgcatatcaatggtcataggctgtgcaatacaaggagagaacttccaaatctcaatgatttagagcataggcagattttgttattatcatttccttataacattgtgtggttcacatcattattttatcatcatcatcaaaagcctcatcattaatctattattcactaagccaccatatggacataaaaatgccagttatcatacaaattaatattttcatctttccttacttatttcaataatttgttagcttttaattttgatagaagcaaaatgctaagaccactttagagttgataattccaccagtaacatctgataattaggttgacttatgtcagaaaagtcaggagtttcactaacgaaatagaatgccacataaaaattcagtaaattttagagcctgtctgtacaggtgattggattgttaattttacaggtcacttgctggagcatgaatagcatgcaattggtatgtttctcagagctagattattatgagagtgaaaaaagcctattaagtctaataaaagccttcattttctttatttttgtagcatttcagaaacttttgatcaattatttacatgacctgtaataaaattttcaaaatgctgcaagcattccagtttagcattaattttcaaattgctttggttttatctatttcttaacttgtgaagggatttctagaaggcagaatggaacatagtaaatctttttttaaataaaattgttcaaatagttggagtagggctccctgctggatgagtgctgagcttaccattcatctaggtgtggttagtacatctccttaccagtatctatttgcaatctgctgatttatactgctgtccaggggattcctcgggaaaattatgtggtctgtccacaattacagtttgaacggaccaaagttttaaggggatggagggattcatagtggtcaaggaagcaaagaaattccatgtacaggggctgactgcagcaaagagaagaaggaattcaatgcgacaaattggaactgttggtgagaaggtaaatttgtacaaactctatggaaaacagtatggaaatttctcaaaggactaaaaatagaattaccattcaatccagctattgcactactgggtatctacccagaggaaaagtaattaatatattaaaaaggtacccatactcgtatgtttattgcagcactatttacagtagcagatacatagaatctgctaatggacctaactgcccatcaatagatgagtggattaagaaatgtgccatgtatacacaatgaaatactattcagccatagaaaagaatgaaatgttttttgcagcaacgtggatggaactggaggccattatcttaagtaaaacaagtcagacacagaaaaacaaatatcacattttctcactcatatagtgcaagcaaaataatgtacacacatggatgtaaagagtggaatgataaacaatggagacttgaaagggtgaggtggtggaaggaaggtggataataataaattacttaatgggtacaatgtgcattatttgtgtgacggacaccctaaaagtccagacttcactaccatgcaatctattcatctaacaaaattgcacttgtaccctgtaaatttatacaaatttaattaattaatttaattatatcaagacaatcattttaagaaaatggtgtttctgggtttggagtaatagctgctgcttaacacattcagtatattctagggaatatagattatttgggagaggatgtagtgtagatgtgtggttcatgaaaactgtgaataattccaggacacaaacattaactctattacactatagaggtgaagcagccctactgtggcatctccttaattgcaaaacatggagagagaattttctccttctgacttggctgagttgtctcatcactctgcattttgcacacctccatggttgggcaattatcagaattgagtcttaagatgatcagtgtcctgagtgaatactggaacaaagaaaccagggacttggtgaggacaggtccaatactatgtaaaatcgccaggaatatttggagatgaggaaaactttgaagcctgcttgagcgaatgggaagtatagtgctaataattcaggtatttggtttgttgcaatcttattttaatacctaaatactgggaaacttgtgtggttttgtttgatggtaaactcaagactgcaaaaatctatgatcaatttagtcttagccatgaattcttattcttctgcaaaaattctgttgttattgttcacaaagatgaatatcctttcaaactgatccttctatgaaattgcttaatctttaaaattcagtaggaaaacttataacagttggaatactagaaaacttcttttttattggtaacgaagttcaaaaggcaacttcctagtggaaatatggagggacttgaaagattattcttactagttaatttcaaatattctctaagattctttcataatgtctcagttttaaaaagctgaaacacatgtcagatgaattattacatattttaaaatgcaattgaaagatgggaaaggattatggcaaagtatttaaatagtttaaaatctacaatgcttaacaatatgcaagccagaatcttaagataagttcatctatgacagttacttgttgacttgcttacattcaacaattttctactcttgattataaataccatacattttttctaaacttcctgagttatttcacacttcttcattaattgatgtcaaattctgctttaacaagaacagagatggttagacatgcatttttttatttaaaagtggtagataatgattataaaggccattttccgacagctattttttataaaaaatttattaaatgattaaaatttgttacatcattttatataacaaactttaatcatataatcacttttaatctccctgtgtgtgtgtgtgtgtgtgtgtaattcaagactatatatataaactagatatatgtaactgtatatatgtatatataacttatatatagtcttaaaatatacacacatatatacatataggtatatacatacatatacacacatatatgtatatatgtgtgtatatttatatttatatatagtgtatataactgtatatataactatatatacacacacacacgtgtgtgtgtaattttttggtggggataaattaatttttttctgaaatttgttggaaaatgtctagctgataagaaacattaaagataaaaaagattgcatgcaaaaataccacaaaagaacaactttagaaaacatgattgctttatctgtagggatctgataatatgatgttatatatatgctgaacgatatctcaaacatgattcaacaaatgtgtatacagttttaagaataatgtaaaggcaaggaaaacatttaaaaaaacctaacttttgataaacacaatggaaaatacacttactttaaatataagtaaatcaaaagagaaagcaaagcaacaaagttccttcctcattatacaggaaaggaaaatcagatagtttgtaatataccagattcattaaagcaaattctacctgtaaaacacatactagcaatgagaggcattagagacatttaagtaattaaagaacaagtgagaaaatctttaagtggacaagctaggtgaaaatctgagatttctgatggaatttcatcattatctttctgcctgaaagaatgagttttgagagaaaacttagtatcagggctgcaattcagttagtgatgctccactggtttacccagatgtcaatttttcccagtgaagtaagacgagtttcagtatcaacttcaaatttgatctatggtagatatgtttagaaaatcagaaacactcctgacttagcaagctcaataagcttttaacatcaaaataatgaaatccaatgactcaaattgaccaacctttctatcatttgcattttcctttgagtttacatttgttttaattattccatgtttcacttctttgcaaaaacatttgatagctctagtaaattgtcttcttttattaagtgtcattgtcaaatccaaataaatgattgtggcttactctattaaagagatggctttcccagcccctagataatgttgcaaataataataataagagatccaacacttattgaacacttacgatgtgtctggtgtacctgataggaatctggtgatgactactgtatctaatcctcaggaaacctaagaactgaagaattatggaatttgctgaaagtgatgtggctagtaaggtatagagccaggttttgcaccaaagtgatgtgactgcggagtttatgctcttaatccctctacagcatggcttctcacgtctgtgtccatatccacacagtgacttgcagacacacaaaacagatgtttattttatgtatctgaatatgtcatgttttatttattaaattacttaagaaaaataaaaatatcccaccacagaggaaggacatagtctgcacacagcctacagtattctcataataaacatatgctcttgatttttgacaattctttcagtcttcttcttctttgagtcagttgtagagaagggaatctgtgtctaacattgactcctttcccccagcctggagttcagttttgtgaccacattgcagctccataaaactgtcttgctgatgcctcggtggttgggccctaaatctttagagaggctgttctgcctgtgtagctctagaggcccaacgcagtaaatacaaactccagacacccctgcttcctatatgtcccgggtcttagagacgttttcagtaatcctgccttgccctttacttcccagtgtgtttcttatctctcagcactgggccacttgttctgtttcttatttatggctctcatattcattgtcagatctgatgttagatagcaagccacgggtccttggtactgatatcagcaattccttaggtaactgcacaacaagtgagaaaatctttaagtggacaaactaggtaaaaatgtgagatttctcatgggacttcatcactaacttctattctcgaatagtgagtcttggaggaatgcctaatatcagggctgcaaatcatttaataaagatccagtaattagtacttgccctcaaagctacgtttgtttctatctgtcaaaaggtcccttcttatttggtgccccccatttttaccttcccctgccttggatacatcccaggccgcttgagaggttcagtgctaccatttgccagtaactgctctcaggtttttgttatttcatggtctggaggttctttttattttatgcttcttcatgatgtcacctctgggtacacatcctctctcaggttgctgcctctcagattcattttcacgccttccacttctaaggtgtatgttttcaagtccccttgctcttgtgtgtccttttgtgttttattcttccttgacttctttttctttgccacacttccactctgtatctatgcatcagactaatatatatagacttttggaaataaaataaaaatgaggatgggtgattcaaatttatttttttaataaaaaaattgtaacagagacatttctaaacctaagtttgaagaagtcagcaaatagaaatagtcatttgagcaaagtataaaaaactctagaaataatcaagcttctgtaacttctgaaaaaaaagatggtttcacactctgtttttgatttctagtaagaaaatgaattagcatttctatagccaactttcaaattttctctgtgattcaatgtagtctagcactatatttataagaatctttaagaactcaggagaaattatatgactttaaaagcgtccaaaatgattgctgtctgtgtcagtatgaaagaatgttttgggaaggctggaaagtaaactatagggggtgaaatttagggaagaaaagaacaaggtggtgaaatgtagtcactctactttagcgtttttgaataaaggatagtttcaggaagattaaagttatgtccacaggcctcgtgtggatagcaacataggccaaatccaaagggacaaagatttctgtacctgaagtcatctgcattctgccatgaaagagacacaatatatatgaagttgtatgtagccactagggctgaatgctaggccatagttatggccattctgcagtgctcggttcatggaatatgaacttgaaaaatattaataggtcctagatgctctggatattctaggcactgcagtggctgctagacagccgggtataatcattgcaagcacagtcattggaataaaaataacaagattcaagtcctccatcatttatttaagctctgtgatcttgaacaatttacttcacctctctgagcctatctagggaaggaaaaaaatgtgtcagtctcttctctgaccatgttcttcactgtcactctcactgaaacctgacttcctcctgagctccctgcagctctcccaagtaaaggctgtttctagagcaaaacacatacaccccagccccttcaggtaggaaagcatcttccatgatcctcactcccactttgagaccatttctcccatatttctccctaaagccttcaggtttgaatttcaggccaaagaattagagcagccttgcttattgcagtcctccagattaccttccttcattccttaaagtagttactccaggttcattgtctttttctcctgcatcaataagattttgtgatttcaataaccacactgatggtccttccaatgccctgtttttgtgtcctaaaaaataatgtttgctatctggtctcaccgactcatttctgcagtcagaccctagcctgcactgcccagcatagtagccaataatcacaggtgactattacaacgtttaaaaattaggaattcagtctctcaattgcactagccacatttcaagtgctcagtaggtgcagatggctagtgactaccatatttgacagctcagaacaattccattatcacagaaagttctacaagataatgctgcatcctagaccgcaatattatctgcacctgaaatccctccataatgtcagttttatacctcccactttctgatctttactttctatctttccagctcactgcctctagctgcctgactcaaagaatcagtgatccaccttggacatactgttcattgagcttagcattttttcatacttctaatcttcctcacgcttttcctagactctttaatccacttgagtcacattgtataatctctaccttgcctcctccctcacttctgtacattttcctggctaaaatgcagtcttggttaggtcaaactacctgcccagttgtatataccacagacgatataaggggctggagaaaattccataaacctgactggcccaattctgtatgcaatacctctaattttaagataagtaaaaatgtttctgagattgaataatttctattgattggtctaattcagttatactttcttctacattatccaaactgttaagctcattcagtgaaatttcactttaatattgtgcttttctgttctcaaatttccattcagtttctatttgtctgtggagtttcttcatttgttcattcattatctctatatttacccttaggtctttgctcttttaaagtccttgtctactaatttcaacatctgagtcattgcatagtctgtttttatttataccttttttctttgagtatggattggttgttcttgcttttttacataccagctagttgtaactcaatgctagatattgtgaatatatactgtagggaatctagattatttcttcttcatttatagggtgtcgattttgttctggatgacagctaagttactggcagccctttttgatcctgacagacatggttttgtctctgctggtttctctctctctctctctctctctctctctatttaattccatctactttctcagttcagaagactgccatgttgtgttcaagctccacctccaaagaagaaaaccaggtcaatgtagggcttgcttcatgtgtttccctactcttaaagatcatgtcactcgatagctctgtggctagtacctttttcatggatgaaagtagaagtttgtcctaccttcctttccttttcaaacttttatttgcaaatgacacatatccagaaatagacataacacataatgtacaatttattatttaatggaaaagatactaccaacaaagcttctgtctagctcaagaattagaacattttcgtcattgcagaaatgtgtccctaccgtgtatacccattcacagtcacaaccccattcctcttccctaaatgtaatcacgattctgatggtatggtaatcatttcttttattctctttgtacttttactgtttcttttattctctttgtgcttttactgttgcagtagacattgctaaagacaatatcttagcaatgtataattccatttatgtaatgtctgaaatgtataattccatttatgtaatgctacataaatggaatgtctactgcattacataaatggaatcatacattgggtaaatgtgcttttgtgactgacttcctttccttaacattatgtttaatgagctttatccatgttactgggtgtaactataacttattcatgtttatcaaccctctctttacctcactgcaatgagtcttatttcatattatttcacctaaactgtcctagtaagagttgcctttgaccttcatcaaggttggctcatttatcttctcaatttgaagcactagactctctaaacttcctccctgctgttctttcctcgacctccaacttattcagccaattcacagacaggtccacaggcagcctatccacagcaactaggaaaagaagcatgcagatcaccgttatgtgggaaccacgtaataaacatatatgtgcacgcagtgcatgtgcatatataaaagtggtatctatctatctatcatctatctatctatctatctatctatctatctatctatctatctatctctaatttagctattctgggatatgcaggagtcttccattttatcatttaatggccatgtcaaaaattttaaatgttagtttatttaataaaataaaattttaaatggttgttgtctttaaacttaattctaggggaaaaaaagatgtgcatggagtccggttctcttttacaaagttaatctgaaagacaatctttggtcatgggctcagcaaaatttcagtttagatatgagagtatgaaagacatcaggaatgtggatattttttaacttgttcacaattctgggacttcttatatctttcattgtggtagaaaattgatcatttgggagaggcattaaatgaaataaaattctttcttttattgctgggagaggtcttctttaatttccttagatgttagtctatctctgaagtcttatcttacatgctgaagcatattttttgaactatccaaaagggtcctgttctttttctcattttagttattagtctggagattgccaccattctaggatctgtatgacatttttgtattatagctaaacccaagagccaattttcttattagtggcaagtgagtgaagagtgaagagaccataaagtcagatagttttacattaggcttgggattggtgcccagaattataatttacatgcaagaactacattctaagtcttgtagctactcttacctctgaaaattaggtaaaatcaccacttttcctcaaattaccttgatacattttcttttttaagaagtacgttgagtgcattaattatcctgataattgtttaatcttcttcattttgttagatgggttgagaagaaacttttcctatttaaggcaattttgccacgtgtaattcatgtactcctgagagtatgtcaaatgtgaaaaaataactaggctgtcctgtctactctcataccactgattatgatgagcacgatttcaggctcaggaagatattggtgccacctcgctggagtgaatgaaaaggactggagttggctacagttgcgttgcatgaaatgcattataaaatcacgtgcttccatcccatagcagcattcagacctctggaaaatattatgctccagttttatcagtatattagagtgtgttttgcagtcatttggcagccaaaaagctagagatatatggtatgtttccactgcttatttcatatgcttctatttttatcagctcaaatctgacttaaaggaatgatgatccagcatccatcccatggaggtcatgggaattattgattgatgcagccagtgcatgggaaggtaaactctgaacaacttgtcattccaagaaacacttgtgaagaacagtttgttccttgagaataagctgataaatagtccaaggacagaaaaaatgttatacagctacaaagggtgatcaaaagctgagtgaatataagtggatggaaactttagaacccctctggcttcacagccttccttataccaactttgcatagtagtgattctatgtgcatgtatgtgtgtgtgcatgtatgttttgtgtgtgtatgccagcaattatgatatttctgtggactaaaagtctgtgcttaggaacatggtccttataaatattaacaagtgactgagtagataaaaagatcaatttcatggcttccccatagctctattatgagttattatcctttaaggggtttaatagtgttgaggatcattaaatttcacaagctgaaggtgagattgacagctggttatcgacctaatatctactctccatttcttcattagttaaacagtctcaattttatctatggtggtcatgttcccatttcaatcattcttgcagttaggtttgactccatgatttttaatcaataagaagtttcttattcaaactgctttaaaagtataccatagactgggtgacttacaaacagcagatatttatttctcacagttatgcaggctgggaaatctaagatcaaggtaccagatgacttggggtctggtgaaggcctgcttcctagaaagatgtcttttcactgtagcctcacatgacagaaatggggcgatatctctctggggccttttaaataagggcagtaatcccattcacgtgggttctgccttcctaacctcatcaactcctaaagaccctacctccttatatcgtcaccttggggattcacattttgtcatatgaattttgtggggacacatgcattcagaccatagcaaggggtatttagatttaatcaacatgaagtattttatctgaattctaggtcagctcttgaaagagagatttatttaagagatgtgtcccttttgattctcttcccttcctcttctttattgcccgaagtatgaatataatatctagcgctctagcagccatcatgaaaacattttccagcataagaatggaagtcatatgcagagataatggaggagagatgtggaagaaggctgggtcctgggtgagtttgtaatcactgtgcctgctcaggactgtcaatcgatctctgcacttttatttttgtgagtgaataaacataagcctctgatattttgaggttctctcttttcaatacctaaatataatccaaaataatgtattttgaatagagaaatacctagtggtaaatgcagggataaattctggtcataaggaaagatatgacatttatatgacatatatatgacaaattttgcactcagattagaaaagagtttatgtagtcctaatttcaaggttttctcaaatgacagtttttaaaaaagtattgttatacagaattgcctgattggatggccatttttgcgtgaatctaactctgtgtgtgtgtgtttgtggcaagagagacagaaagcattattcttattcttccatatatgtgtacggcaaattgtcaagctacattttttttacaatgtattttattgtgaaattaaaaaccagcaataactattctaaggtcaattaagaagctacaactgaatgtgcagggtttagatcttggctttactcttaattagaattgttcatgaatcacaatgtccctactcacttgaaatagattgagtcacaaagtaaaaatgaattttagacctttctttaaccacaaattattcattctgtggtttattgggtttatgtatgtgcacataatgaggtttgtattactttctataaatgctcttgtcacacatgctgattctgactttatgtgtgtgtgtttgtgtgtgtgtagatacacttaacacataagtgtggatgctgaaaacatggctatatatatatatatccccatatgtagttgcatattcctacctcttcagatttttttgttatttcttataaatctcttacctttaacttaatggcgttcaggttgtctctccaagtaagctttcctttgtagcatcagctctacttcatgaaaacagaaacaggatatttaatttcctgcaatgcttgttatcacctcctctacttttattccatagcacttatcatgatctaacatgctatatgttttttctgtatttctttattattgcctaattcccccactgaattataaatcccttggaagatccaaattttgtctcttttgtccactattgtattttaatacttagagcagtatctgacgttttctaagcattaagaaatatttgttgaatggataaatgagttacagtaactggtaaaaataattactaactgagaagctcttttaaggaaacaccattttagtattgaatactataagctatccattttttaatgtcatcagtggcaccagataataacattccttgatggtagaatcttttggacattctttacttttttgtttcccaaataattttggaagttgactattacgtgtgtgtaaaaatgaaaactttcaaataatttgaagaataataaaatataaaggatgtctaaaagaatctatcatcaggaagaggccatgttttaaaatgttattatccttcactgcatgggatgcaagataccttggagggaaatggttctaattttgctagtcaggagatggaggtgaatggaggttaagtggcgggtcccatataactcatttagttgctgcactactgatgatggcccaggttttctgcaggcacaaaggtgaaactcaatatcatacatggagccagaaggcaggattgaattctcataatgaagaattttatggccttgaaaaacagtatataacattacttaagcctcaacaacattaataatacctgtttggggatagatgtgaataaaacataaaaaaaattacctgtgtttgttattcgtgtcctgtgctatctccattacacatttctgagtgtaagttgctagatattttctgaggtgaaattagacgacttgttgtgagggaggagtcgacagacatatttgggcatattatgaattactatctaaaataaaccctttacaatattatttttatgttctaacaatattatgttatgtttttacaatattatttttatgttttattagctcaattttggctaattttaagtaaacaaggaattctattaatcttgactattaatattgcatatatttttagaatgacttagcatttaactgtacactaatatataggccctttttattattttaaaataagaagattctgtttgggacatatttggggatggctctgataaaagatacatgctacttaagttatgtgctgtaaggacaaaggctatagttaatttattctcccatagaaatttagtttctgagttctcacattttaaaaaatccaataagcatcttggggttaaggactgatgttatttccgtgtactttgccaaagccaaaagctgtcaacaaatattttttggtccttactgacagactctgtgttatgtgctgtgagtctggagataagggaagaagcattttacctcactgagctcagagcatattcaggttactgaataattatgcaccacctggtaggtcttctgatacagcatgtgatggaggcacacagggaggcccctcaccgaataaccatgctcagaccaggctttctgaaggatatagttttaaacatgggcagatgttccagcattggaggggaacaaagatgctatttcaggcagtggcagcgtcgcaaagtacaataggcaatgttcaagcatataggaaaagagaaatattaaaaattgcttagaaggacttgagtataggcaatgtgttcacatgacacaatgatagctagagtgacaaccaaaccttgcttctttttataaacctttttgcaaaatctgaaagtaaagaatcttgcaagaggctcaaaagtagccattgtaagagtttatagcataactttaaaattatttattacacatgaattattgggtgatgttttgtagaatagtatcctaaaacttagaggggtaatgaaacaatttgccatcccagccactctgctggacatgtatttagaaaaatcatctagatttgagtctatattatgatatttaatttttcaagccaaattactcaatagaagatataaagtttatatattttttcctattctcagcttactgctcctaatacaaatgaataatcccttgctatattcaggtggttttttgtaaataatatttagcatattctgtcagtttgggtagatatataatttttaaaattaattttatttatggatattgtttggttgtgtccctgccaaaatctcatcttgaatttcaatctgctgtgggagggacccagtgggtggtaactgaatcatgggggcaggtctttcctgtgctgttcttgtcatagagaataagtctcacgagatctgatggttctataagggggagtttccctacacaagctctctctttgcctgctgccatccatataagatgtgaattgctcctccttgccttctgccatgattgtgagactgcctcagccatgtggaactgtaagtccattaaacctcttccttttgtaaattgtccagtcttaggtatgtctttgtcagcagcatgaaaacagactaatacatttatcaagagctctgaataaacatttccaggtttctgttaatctgttatacagtgatcaagcatagtcatattccctatagacaaaatgctttcatctattctaattaacagtctgaacctctagcattccctaaatggaaacctagaaagaaaatggttccctaaggaattaccatatggcaagggccataagggcaactctacttataattttttcagccttaagttcctctgccatttcttccacaatagtttgtgtttttctttctttctgaacatagaaaattcttcaaaaatgtgcagtctctattcattaccccagtcttcatgtacagtgaaaggcattcatgactgactttcatgtaacagcaaagaacagaaggacatttattatcaacttgtcaaagaacatagagtttttcttgtttcaggtgttaatattttctgttaccaaggcgttcatcacttagacctctcattctcaggtaaagtaaactttgatgtacctcatgaagaacaaggattgtctgttagagaaaaccttgctaattaaagtaaatgcagagggtttaaaaacttttgtgcataagattatatgagaaaattatctatgcttaaaaattcctgataattccatgaaaaattatgattctgttgaacatgtattttgatactatgcccctgacatgctatgtatgcttagaattatgtcaatgccacatcacttattattccaaatgattcttgaaaattgatgtggaatagctataatgactgtggtttgagtcatttcctgggtattaatgaaagagtagtgttaatggccctcaacattttcactttttgaggttatttattccagataagtggtctgtggtaaaatcattattgattaatttgtattttttctttaagactgctcatgttttcagaataaagtggtgtgctttggaaccacaggggcttctattttctactgagcatcggaaacagtaatttttaaagaaattttgttctgctaagtgtgactggaagaaagggtctacgtagcatgggagatttgatttagttttgttctgggacactcttgtgtactgtttctacagaggaaatggcaggatttatttatttatgtatgtatgtatgtatgtatgtatttatttatttatttatttatttatttatttatttttacttttgagatggagtctcgccctgtcacctaggctggagtgcaatggcatgatctcggctcgctgcaacctctgcctcctgggttcaagtgattctcttgcctcagcctcccaagtagctgggactacaggtgcatgccaccacgcccagctaatttttgtgtttttagtagagatggggtttcaccatattggttaggcaggtcttgaactcctgacctcgtgatatgcccacctcggcctcccaaagtgctgggattacaggcatgagccactgtgcccagcggcagaatttattttatgttacatactacagtcacttacctgcttcattttgcacagacttatgtatgctaccacatttaaaagtttaatttgaccaattgcactgcatgttaggactatgctataatttttctattattgtggaaacaaaaatagtactcataaatttctcatcattcagtttctcttggaaacatacaaacaactatgttgagtttgcaacttaagtcagattatcctaagttttaaaaattttctttgaaattttgttacaaaagtcttccaacattgggaaatataaaataatatatatttttgtttgtaaatcataattaacttacatcacttgaattaaaaacaaatataaagaacacaatatttgaaaactttacccaattacaattaaggagctgtgttaggaaggtacctgcctttgtatttgattacctttgctccattcataagaatactaatattaatgttatgcttatcatcatcagttacctatgagccacacactgtgctaggcatgttatatacagcaatgctgcaatgtgattctgatactaaccactcagagctagcgcagacactgtacaagcacacagtccccagtaagactgcctcgctttggatgtccaccacaaatttgggagtccctgggccacgcattctctgattaattgtctacaaattcagggattcccacatctctctcaggtctggtaattcactaaaatgactcatagaattcaggaaaatgctctactaacaattactttttttttttaaataaaagttcaaatcaggactagtcaaacgaagacacacatagggaggagtctgggagggtttcacatgtagagcttctgtacccttacattgtagaatcaggtgcagcacccattggcatccttctagcacattgatgttttcaccaaccaggaagagccaccgaactttggtatccagaatttttattgatgtttcattatgtaagcatgattgattgtatcattggtcacaggctttaatttaatcttcagcttgtctcatcttcctgaaggtgatcagggagatatcacttcgctcaaatcctcaatcctctcattacaaagttggtctttctggggtgatcagctctcatcctgagtcctctattatcataaccattcatgcttgacggtcccaccatgaataacaaagacactactatcacttgagaaattccaaagacttagtttagtggtcatctaccaggaatcaggggcaaagattagacaaattatttattatataacatatacattatatatgttctttaattatagtgatcttcaaggtgtgcattttaataaagattttgtaggcataaaattgagccttagaagcacaagtcctaggcatataaatcacatcaccggtagtattgaagtcaggattcaaacccagatctgctttattttagtgtccatttatccaggatttcatctctgtccttcttggtaccacaattcagtatcttagcttggtatttttctacaacataggcttaaagagatgaaacctcttgcctaatatcatccagtgaagaagtgctagtgctgaaattcgaacccacattcctcttagcacagtgatggtactcatagctgctctataaggaagaaaaaacagcagatcacaaaagatgaaaatcccatacagccctggaagaacttttccagtaataaaggacattttgacattacagatatcattctcattctcactaatgagaaatgtcagatatacatattttcccatttcctggaaactgtagttaaaaaaagaaacactcttaaaagctgtaaaataattgttcttaaaaacttgtggattcctagacaaaaactaaaagaaaaaaaaatgcagattatgtgtctcttcatcccagtattcttcccattaacatctattctggtacccaaaggtgacaaagaagtccttatatcagcctcatatgcatagtatataggtattgttcttatttcggtgtattgttttaaagtggcacagttcgcaacagcgaatccatacaggtctgcagcagcctcaatccttgcctcctcagtagaaagaatttgaatgagggacataaggcagagtgagagaccaaggcaagctttagagcaggagtgaacatttcataagaaagctttgaagcaggaatgaaaggaagtaaagtacactcggaagaggggcaaatggataacttgagagactctagtgcatggtttgacctttgacttacggttttatatgttggcatgtttccggggtgttgcattccttctcccctttttcttccccactgatttttccttgggttgggctgtccgcacgtgcagtggcctgccagcacttgggaggggccacatgcacagtgtgtttacggaagttgtgcgcatgctcacttgaggcgtttttcccttatcagtcggatgtttgcagaggaaggtcaaatactagttaagcgccatcattttgccttttagggtgcctgcttgaacgcacttacccaacctctgagatcttattcggaagcagctgtttaccagtttcaggtgtttttgtctatttggagaccgcctttccctcgctccagctgtgaccaattaatattttagacagccagcttaacaactgtttggccatcaccagatattcctggtggtggccgagggctctctcctgccctgctcatgtctgactaactacctcctgtaacagtacagatcctgatctgggaacgaagttgaggaattaatggcagaattaagggtgaaatttagaaaagtataggccaataaattattaaacctgtatttccagatatcttactgagattcacatattcatgtatttcttgtttgatgtcttttatttcttttttattgcaaagtagctgcaaattttcttttctttctccttatttctttttacctcgtataaataactgcaaaaggtcctactgctaatccacaatagtcagctaaatacacacctgcatacagaagaaagatttatacaattggcgcccacatgattcaatgctgtacaaaggtgtattcaatgcaacacggttcagcaaacaatagcaatgaatatttattcaaaattttatcaacatctgtgacacatttttcaaagagtaggccatgtgttcctaatacattgaagtatattttaaatcattgtttttgctccagtcactataaataaccttcatatgaacggcagatacttcctcaaacttctctctttgcttctttcctctcactccaggaaatcccagtcatttggcctttgttctttcttcctttccttcttatgttgttcatttctctctttaatcccctgaaggaaatctgggccattctaaagcaaataatttgtttagttctgttcctatctattgctcagatctgcttccaaatactaaggaaaggttctggcagaaaatactgtatttgcaggtgagtaagaagtcaggtttctaaattttgtctcaacccacagtgaatattcaaacccacactttaaaaatttagaaagaaaaaaacaacaactgtacatgtgaatagagtgccttaatgaaagaaaaaagtgtttgtctttgttttgttttgctttttggaaaagagtatcactctgttgcccagattggtcttgaattcctggacataagtgatcctccagccatgacctcccaaagtgctgaggtgacaggtatgagccaccatgcccatcactttcccaatttttaaaataatgaattgatttagattaatttttctcattgattcctcttgagtatgaagatagctttatgaaaaatcttgcctctcgttaatctatgatattctgatgtttctggaaattctagatttttcacaacagaaaacagaaggatggtcaaggtaagagcactcatgaaattagtcaaaatcatccctttataaaatttagtgagatctttgaatgttaacattgcctccatctgcatgtacagtgtaattataccattaacatacacagttttattctaatgagatcagtgttctatagaattgatacaaaaaggcagtgagtgaaaacaatgtcttccaggatccagaaggtactccaattgagaaacatttaaaggaggcatagaaaaacatgacatattcttgtgataaaaccatgtgaaaaacatgcttatgctttgttacattttgtcaaattaatcttttcattttacaatcagatttgggaacttcccaacactttcaagatataaaaaggcataacaattattaccctttttacatgctgtactcatttggcattaataactgcaattgttttattttatgcagtcttccatacaaattatctcaatccactttatcgcctgaaatattttgaagaaaagatttacttaataaaatagcatactacagaataaaaataagtttggaaaatatattcacaggcctttaattatttaatacatgtgtttcattgttcaagaaaacaataaaataagggaaacaaaaattggtaatttttgtgacattaatctcttgacataagatagtaaaatgacttaataatatgctacgttttgtcaccctgaacttctctttaaaatgagaacaccctattataaatttatttttaaaatgctacaagaatttttgggaaattgtgtgactactcctattcagttttaaactgtcacaaagccagacataaatctgttcatgcattatacacatgggacttgtagtgtcttgtcttcacacatttacttggctattggtttctttgttaaaatgtcttccttcatctcttcctaacaaaagtatatttattcatcaaggttcaggcttacttacttcttatatggtttaatcttactatgtctaataaagattaatctttctttgttgacatgtctttatatcataagcatgttaattctttacaaaaatatttctaaatattatttaattcaaatacttttttgtatttttttattgtcaatgtgttagaatgagtggaaaatggaaaataattcaacaatcttatgaaagaatgaacattgtaagtaatcttcaaaaaaattaataagttgtactttaccatactggaaaaaaaagaaaaactgctataagtttacaatgatcagggcattttgggattggcacagaaatatacaaatatatcagctgttgcgactaccacaagcaagatggcaatgcatattacacccaatacctgtcttagttcctgtattctacatctctgtttgtgattgtgatgctacacagagaggtgttttgtattagagagaggagttttgtggagaattcaacattaaatgactctgatttttttacaagttatgtgccaaatgataatttttcctcagatactgaaggggaactgaggctcaaggaacctcaacaactaggaagaagcagatgagggatttagagctgttgggtctgcctaactctgacaccaatattactctccatcaatcacattttcttcttttagtttttctttttcttttttattttaaactagatcaagaccaagtccccttctcctcacttttgaaaataacttcctatttaatatttaaatttattttcacataataggtacttttatattaatgtataaatacgattatcttttcctgtataacatacttccaaatcagtagcttaaaaaatcctaattctctttgggaggccgaggcgggtggatcatgaggtcaggagttcaagaccagcctgaccaagacggtgaaaccctgtctctactaaaaatacaaaaaattaggcacagtggcaggcgcctgtaatcccagctactcaggaggctgaggcaggagaatggcttgaacttggagggcggaggttgcagtgagccgagatcgtgccactgtactccagcctgggcgacagagtgagactccatctcaaaaaaaaagaaaagaaaagaaaagaaaaaaattcctaattcttctcccatttatgtggattgactggctttagctgattagttctcatcgaaatctctcatgtgctgaatcagatggtttcctgggctggaatcgtctctaggtgcaactggcctgaatgtccaaggtagctcgcttatataaatgacagttaatgttgcctgtaagctggtaatttagccagggctgttgaccagaatgtccacacagcctttccgtgtggcctgctctacttattacagttggtggccatattttgagaagtggaatccagagaatgagtgtccaagagtcccagcaagaaactgcaagatctcctgtgaattggccttgaaagtcccagaatgctactccataggatgctataggttatataggataggcaagtcactaaggctagcccagttttgttttgttttgttttgttttgtttgagacggagtctcgctgttgttggcccgggctggagtgcagtggctcgatctcaggacactgcaacctccgccttcctggttccagcaattctcctgcctcagcctcctgagtagctgggattacaggtgtgtgccaccatgcccagctaatttttgtattttttagtagagatggggtttcaccatgttggccaggctggtctcgaacttctgacctcaggtgatccacgcactttggcctctcaaagtgctgagattacaggcgtgagccattatgcccgaccggctagcccagttttaagggatgaggaccacgcatttgaaagtagtgggaggcatggttcattaggaggacatcttggggaactaactatcataattacaaatatgttgtcttttgtaatttagtctttgttgttttcatttttgtttaccttttattctttttttcccacccatgtcagtctcagctccctttacctaactaacctgtattatcagtctcatatatattccttcatgtttttccacacttcatgatcataaaactgtgtatatttcacacacacatgaagacacacattcaatgttttattttatatttgaaattaaatggtgtaggtaatagtacacatctaccttttctacacctagtttttcaattgaattttatcttacagcaatctctctgagtcttctccagttttaatagacgcatcatattccatggtatttatgtgctttactttaccaagttcaattatagacatttattttgtttccattatggccaatattaataacttaataaacatcttagttatattatttcataatttttgtaaagaatagattcctaagaatgtgtactgtgtgaagggcatttctctatctttttatctttctatcatctgtcatctatatatatatatatatatatatatatatatatatatatatatatatatctccttaaatttaaaatatattgccacagtgttttccaagaagtctatgatgattctcattttgattaactgagtaaaagtgtatccttttttgtcatagtttttaatgttttgtcatcctgaagggtgtaaaatgatatttcactgttattttaatttgcatttacctcactaccatacattactcctacaaaaaaaagggtggatacagaaggacttccaggaaggaacagtttggctgacctggaatttctggctctggatagcttactttttctgaaaggaacataagctttacttgagatcaaataactaggcaggtcacatacctcaatttaatgccagccttgaactttttacttccagattaccttcccccctctccctccaagtcttcttccctcccttcccctcccctcccctcctctcccctcgtctcctctcttctcctttgcttttcctatttgttccttttctcatttcttcttttggcctcacactttctcactcccatgtcctcttttttttctgtctcgttatatggaatttgtcattcctatcttcacataaaaaaaaaaaaacagagtagtacttacaaagatttttactgtggaaattttgtaagaaattgaaacaacctttgaaaaagaccattatttggccaattcaataaaaaacgccaagcccttgctcatttagtcgaattccttacttccttagccaaactcccttgccaccggaagtgaccatttgacatttttatggcaatgagatgcatgccaaggaagctttgagaaactttcctcgtaaaagagaggtgagtccagtcttcttccttcgaatgtcaatgtgatgacagcctgggaaggcttcctgaaacctgagggaaaaggctgagaatcatggacacgctatcactgatattatagagccactacaccaaggctggcaagtgtttaccagacactttttgttataagaaaaaaaagaaaaacaactcttttggtttaaaatactatactcggggtttctgctttactgctaaagacgttcccatctgatatcaacgtcaatgtccactaatcgaggcccgatgaaaaattattctatactagaatataagtaatagaagatgaaactataggtatggacatagaaagatgcccacaataaagttaattcagcacactacatgaattaagagtttacataatttgtagattaaaaattagaaaggtgttgaaggattacaaatgaattgttaactgtggttgcttcagagaaggggagtgtaagaggctgagagacgcgaggcctggagagatgattttattatttagtatattttgttgtattttttccttttataatgcacagaaataaaaagtaaataataaagaaaaaaaccaaagtggcttatagaactatttaatattttattttctgggacaaattaatatgaaaacataaattagatttttttttaaaacctgtaagtcttttccatcctggcagttttcaatattctatagtactatgcaacatgaaggggtagtggtgtagtaagtgctcttaactaggagacagaagacctattttccattcctgtctctgggaccaacttgttttctagaccttgggctatttctgtttatctttttctcattttattcaagtttaagacaaataggttgcctaagggttttttcccttatctagttctgatattcaataaagagcctgataagggcagaggtatttgacagcactcgctttggactgcagtatattacagatccacactccattgcctgggttcataaaagacaaagctgcatgttcagcaatgtttacccatgtctctgggataaatggcctctaggggatgcggtgtccccaaacatcagccttgagcggtgtacatctctatggagatatgccccaaagtggattgataacatctggacattaaagcacattttatcttcgattctcagaaaaaatccttgtcaatcttttgtctcgtaagttgttgtgaataatatcttggagaaacctacctgggttgtagagttgctgaaaatgatatattatctttttctccagattaaattttgagttttaagtttgagttttctgacgaagtacaggtggctcacacctgtaatcccagcactttgggaggctgaggcaggagggttgcgtgagcaagactctatctctaaaataaaaaagtctgaatttgtaattttgttaaaacatattattattgttattgtaaaattatggcttcaaaaatgatgagtagatttaaaacttgagctagttcttggatttttgaagcattaaaaaattatctagaggaatttctaacacaagattagatttcttattacaaagaagtccctggtaataaatattggaaatttaatcagatactttataagttttacaaaaactttaaatgttgacattccccaaacacttttaattctcagactgttccttgtttggattttcctgtgtctagcccatataattttataatacagatgaacatgagagaagcaaaaatgtgtatgttccattcccttgacaaaagttttttttttcataataattatttagagtgaatatttttgggaggataaataagcacaattatacttttactgtgccttgacaattgtgtacattcaaggcctgcctttcaccactgcaggctgcatttccacaggctgatacaacaaccatcctttcctgtggaaggtagaattgcacccttcataaacattagtgcattgacatttgatactggaaattccagatttgcttaggagttgaaaagaactcttttgttttcctgatggcttccaacgtcactttcccacaaatctcataaatgtgagtattaaatctatgctaccctctcccacagtttggctttattttaaaatttatatgttaaaacatatggttaatcatttcatagcaaattacttattgcaatttactgatactggagaaagtaaaagagactatatatcactgtgcagatcattaagagaaaaggagcttattttcaagatcaggtcaaatattgataatattaccatggaaatatggcctaggtggtaaattaaagacttataaatcaatggtttaaacatattttatagattttcttgatcaataaaaaatgatttgtataaatatttaaatttaatttagtgttctgcatttgcacaagcatgaaaaacatcacaataagctttaatttcctgtaaacaattttacctttatttaacacattcttactgaaacaataattcttgaactcttctaaatagtagttaatgtctgatgcattgttaaaaatgtaatggaattttaatcttcaatattgatttgggggcaatggaacttcctagaaatttaaaatttaattgaccttaacaattacaaagttcataatatagttaaaataatatatatggtataggtgctatgaattggattgtcataaaattattaatatgttaaccatctacagaagatttgtttgtatttaaaagtctataaaattgagaataccaattttgtttattaaatgcttcctcattcttataaataaggtttaaataaatatatgtatttaatatatagtgtatgatatatgtacatatatttaattcataaatgttaaatataatcagtatgatgaaattgaattaaaatctgaaaattataaatgagacatgcaggtcagtagtactatactttactaacattaaagcagatatttgcttttaatcttcccaggacaaaagtaaagaaaaaataaacaggaccaattatgtcaatctcatagtctgtgaaatatatacctatacatattaaatccaattggtcaagtgtcgatgttaagtccctaatttctttgttagttttctaccttgatgatctgtctaatgacagtggggcgctgaagtttcccactattattgcatggctgtttaagtcttcataggtctagaagtacttgttttatgaatctgggaatttcaatgttggtgcatatatatttagaatagataaatcttcctgttaaattgaatcctttatcattatacaatgcccttctttgtccttttttactgttgttggtataaagtctgttttgcctgatataagcatagagacccccacttttttttctttgttttttgtttacattgtagatcttcttccaatgctttactttgagcctatgggtgtttttatgtgtgagatgggtctcttgaagacagcagatggatatgttttgtttttttaattcaacttgccatctgtgtcttttaagtaggggtgtttagaccacttacattcaaattcatattgatacgtgagattttgatcatatcatgaagttgttagctggttgctttgcagtatttattgtctaattgctttatatagtctgtgaggtatgtacttgatatggtttgactgtgtacccacacaaatctcatcttgaattgtagttcccataatccccacatcatgcgagggacccagtaggaagtaattgaatcatgggggaggttttccccatgctattctcatggtagtgagtaagttctcatgagatctgatggttttattagcggttccacctttgctcagctctcattcttccccttcctgccaccatgtgaagaaggatgtgtttgcttccccttccaccatgattgtaagtttcccgaggcctccccagtcctgcagaactgtgagtcaattaaacctctttcctttataaatgacccagtcttgggtatttcttcatagcagtatgagaatgaactaatacagtaaatttgtcccacagagagagggttgatgctataaagattcccaaaaatctggaaacgactttggaactgggtaacaggcagaggttggaaccatttggtgggctcagaagaagtcagaaaaatgtgggaaagtttggaacttcttagaaacttggaggactcagaagacaggaagatgtgggaaagtttggaacttccaagagacttgtcaaatggctttgaccaaaatgctgatagtgatgtagaaaatgaagttaagactgacaaggtctcagatggagaggaggaatttgttggcaactacagtaaaggttgttcttcctatacaaagagactggaggcattttgcccctgccctagagatctgtggaatgcggaacttgagggagatgatttaggatgtctggcagaagaaatttctaaccagcaaagcattcaagaggaagcagagcataaaagtttggaaaatttgcagcctgagaatacaatagaagagaaaaacccattttctggggagaaattcaagccagctgcagaaatttgcataagtaacgaggagctgaatgttcctcaccaaggcaatggggaaaatgtcttcagggcatgtcagagaccttaatggcagcccctcctatcacaggcccagaggcctaggagagaaaaatggtttgctaggccaggcccagggcctccttgctttatgcagcctcaggacatggtgctgtgtccccgctgctttagctccagccttggctaaaagtggccaacatacaactcaggtcattgtttcagagggttcaagctccaagcctgggtggcttttatgtggttttaggcctgtgtgtgcagagaagacaagaattaaagtttgggaacctcagcagaagtctgttgcaggagtagaactgccataaagaatctttgctaaggtagtgaagaagggaaatattgggttggagcctccacctagagtcccctactggggaactgtttagtggagctgtgagacaaaggccgccatcttctagaccccagagtggtagatccattgaaagcttgcactgtgtgcctagaaaagctgcagacagtcaacaccagcccttgaaggcagccaagtgggggctgtaccctgcaaagccacaggggcagagctgcccaaggctgtgggagccacttcttgcatcagtgtgacctggatgtgagacatggagtcaaaggaaggcattttggaaccttaaggttaatgattgccttattggattttagacttgcatggttcctgtagcccctttattttggccattttttgccatttggaatggctgcattatccaatgcttgtacccccattgtatctaggaagtaactaaactgcttttgattttataggttcataggcagaagagatttgccttgtctcagatgagactttggacttgaatgtttcagttaatgctggaatgagttaagaatttgggggactgttggaagagcatgattgtgttttgaaatgtgaggtcatgagctttgagagaggccagaagtggaatgatatagtttggctgtgtccttacccaaatctcattttgaattacagttcccacaatccccatgtgtcatgagagggacctggtgggaggtaaatgaatcgtgggggaggttttccccatgctattcttgggatagtaagtaagttcttatgaatctgctggttttataagggacttccctattcactcagctctcattcttccccttcctgccaccatgagaagaaggatgtgtttgcttccccttccaccatgattgtaagttccctgaagcctccccagccctacagaactgttagtcaattaaacgtccttcctttataaattacccagtcttaggtatttcttcatagcagagtgataacaaatgaatacaatacttaagtgtgtttttggagtaccaggcttcattcttcatttctatgtttagaacatccttaaggatctcttgtaaggccaatctagtggtaacaatttccttaatgcttgcttgtctggaaaatattttttgtcctttgcttatgattcttagtttggcaggatatgaaattcttggttgaaaatattatctttttttaagaatgctgaaaataggctaccaacttctcctggcttttaagttttctgctgagaagtctgctgttagcctgatggagtttgctttgtacgtgatctgatctttttctctatctgttttaaggttttttcttaagtgttgaccttggccagtctggtgattattttccttggtgatgtctgttttgtatcgtatctctcaggtgttctctgtacttcctgtatctggatgcctatctctctagcaagatattccttcaaatatgtttttcaggtggcttgctttttctctgtctctccaggaatgccaataattcatagaatttgtcacttaacgtaatcccttatttctgaaaagcttcattcattaaaaacattttttttctttatttttgtctgtctgggttcatctgaaagaccagttttcaagatctgaaattatttattcagcttgattcagtctattaataaagctttcaactatattttgaaattccttaagtgagtttttcagttcagaatctatgactgatttctttttaagatgtttatctctttcttcatttcctggattgctttagaagtctcttcattttgatttttaagcttgtcttgatctcattagcttccttgcagttcatgcgttgaattctttatctgtcatttctgagtttccattgtgtttggggaccattgctgagagctggtatgatcttttggtggtcactatattcagatttttcatggtgctagaatttttgttcaggtttcttctcctctacagatgctggcacttctaatttttgttattgtgtttgtgtggatgggaatttttctttttcttaattttcttataatattattgttttttctttccccttccctccttatttaggtggtgcatacgactgtacagaatgctgtgtatggtcttctggctttgcttctatagccctgtgaatttctttgggcaggttttatattgggatgtgcagttcaacctacaagccagtagatgactcttataggtaagaggtggctgtggacaatgtcaccaaataatgactgactttgtatgtgccaagattaaaaatggtatccttctgtctgtcctgggtctgcaagtgtctccccaagttagctttaggggttgggaaaaacaaagtgctctctctcagcctgggttgctcagatccccaatggacaagtgagtcacagagggaggctgtctgcctctgtcacatactggtacttcactcaaagtcagctggataccatcatgaggcctgtttgctggtggtcttctccctgggatttgaggtgtccttcacaattcggggggatacccatttttcttcttgaattaaagctcaaatagttaatctttatgcacaatcctgctgtttccaagtagctgaagcacactaagagcccctaattcaccatcttggaaaacaaaaaaccttttgggtatacacccaacagcggaattgccagattatatggtagttctgtatagcagttgtactagtttacattcccaccaacagagcatgagttccctttcctccacatcctcaccagcatttgttattatttatatttttgttagtagccaatttaattggagtgaaatgatatcttaatatggttttgatctgcatttccgtttttaaatgagttatttgccttttattattgaattttctatattctttatatattgtggataaaggttcctcatcagacatatgatttccaaatattttctccctttcagtggattgccttttcacactctggatgatgtcctatgcagcatggaagttttgaattgtgactaagtccaatttattgatttatgtttttcacttatgctttggatgccatatccaagaaattattacttatttcaaggtcataagtatttacatctatgttttcttctaagagaattatagtttagaatcttacattcagatctttaatatatttggaattaatttttgtgtatggtgcaaggaagcagtctaattttcttcttttgcaagtggatatgaaattgttcaagctccctttcttgaaatgactattctctaaaccttaaattgccttggaacttggtcaaaaatcaatgggctataaatatataggtttatttctggactctcaattccatttcattgatctctatatccatccagctttgtagtatatttggaaattaagaagtgttatacattcatattggttccttattaagattgttttagctattatggatcccttatatttccacatgaattttagaatcagcttttctagttctgcaaaaataaaaataaaaatatgtaattttgataggaattgtgttaaatctacaaatcaattttaggagtattgatagctcaataatgttaaggttttctgatccaaggacttagcatgtctttccatgtatttatattatttataatttctttcaacagtgttgtttagttttcagattatgttttacatttatttgcttaaatttatgtctttcttttctgaatgctattgtacctgtaaaatattcttaatttctcttttatatttttcaatgctagtttatttttctttattaatcttatactctgaaaccttgttgaaattgtttactgtctctagtattttttaaatctggatttctttagttattttatgtgtaagttcatgttatctgaacatagagatagttttacttttttctttccagtatgaacgttttaaatttctttttcttgtctaatttttctagtacaaacaaaattacaatgttgaatagaagtagcaagagtgtgcattctcatcttgttcctgaaattgaggtaggagtagaaacatgcatttttttcaccactaaatatagtgctattttgggatttttttattcacatcaattatcaagttgagaaagttccctcaatttctactatattgagtgtttatagtcatccaaatgaatttattttaaatgtttttttttcattttttggatctatcgcaacaatcacatactctctccttattctagtaatagtgtttaaaattaattgattttgtcatattaaagcaaagatgtatactcaataatccacctggtgatggtctgtaatccttcatatatgttgctggattttatttgctagtaatttcgggaactttttgagtcgacattaaaaagaggtattgttctgtaattttctttccttgttgatgtctttggttttggtggcatggtaatagtggcctcatgtaatgtgttgggagcgctacttcctcttctaattttagacaagtatatgaagaaccgatattagttctttgtggtacatttggtacaatttaccagtgaagccatcttgcttggactttttttgtgtgagaagttttgatattactaagtcagtttattatagaactattcagattttgtattcctatttaagacagatttggctgtttgtgtctttgtaagaatttgtccattacatcagttgtttacagtattttttaattctttttctttctgttaatagttatgtctgatatctcattctgatttcagtaattgagtcttctctttttcttcttggttagtttagctaaaagtttttacaattttgttactattttcaaaaaatcagcttcttgcttcattgatttcctctactggtttactgttttttatttcataattgcccaccattaggttttatttttgccctgcctctgcctttgcctctgttttaggtttagtctacacctgttcttccagtattttaagcggaaggtcaggctgtttattagagacttttattatatttaacacaagtatttgaagctatacattttcctgcatatcctactttaggtacatcttttatattttgttgtataatgtttttacgtgggtttatctcaaagtatttgtcttcccctctgatttctcctttgactcattggttatttgagaatattaagttacacaaaatttatatttcccaattttctttccattattgttttctaattttatttcatttggtcagagatcattctttatatgatttcatttattttaaaaatgtattgaggcttgtttcactgttcaagatattatctatgctggagaatattctgggtgtgctctcctgttgctgagtagaatcttttatgagtgtctagttgtttatagtgttgctaagtctgctatttctttgtcgttttattgttgttattgaaagtgtggtatcgatgtgtccaactattattgttgacctttctatttctccctcaatttttgctttgtgtgttgtggtaccttgttgttaacttgttataaagttggtatatcttcttggtggatcaaaccttttagcattacaatattaccatagcagcttcagctttcttatggatgctatttgaacaatacatcttttttcattcattacttttaacctctttgtgctttttcaatttttaaattaaatttaaatcaaaatttaaattttcaatttaacctctttgtgcttctcctgaagacagttgaatttttattttccaatccagtcagaaaatgttatcttttgattggattatttaatccattaatattcaacataattgatatagttgtatttacatccaccattttactttgttttttgtattccccatctcttttttgttcctctattttccttctttatttctttcttttgcactaattattttctactgtagcatttaaatgtattgttttttcacaatatttttgcatctttagtgtcttcttagcacttagacattttaccttctaattctaattcagatttatttcagacaatttcagtgagatatgcaaacttagttctactgtatctattcgttcctcacctttattgtgctataattattacacatattacatctatatactgtatatcacaaaactaataacacatttgcataatgactactttatatacttttgtatcttttatagaaactgcaataaaaaagtaaacatatattcatttagtttgatatattagctttctatttattatttttatttttaaagaaataattcctggcctggtgcagcggttcatgcctgtaatcccagcattgtgagaggctgaggcaagaggatcatttgagcccagctgtttgagaccagccatggcaacatctctctctcaaaaaaaaaaaaaaaaaaaaaaaaaaaaaaagctgagtgtggtggcatgcacctgtattcccggctatttgggaggttgaggcaggaggatcacttaagcctgggaggttggagcttcagtaagccaaaatagtgccactgcactccaggctaactgaaaaaccaaaacccatcttaaaaagtactactactactactactaataataacttgtctttatcaatattcactattagatgatataatcatactattttttacttatttaaaaatagtttaatttacttctttgaatatatatatttataataactttgaattctttgctatgtgtaatatcttctgttgcttgctttttacttctgtgtagcagtgttatattcctatttctttatctatcttgtcaacttgttgatattttagataatatattgtagaaactctggatactaattccccctctctgttaggtaatttcttgcttatttgttccctgatttggctagactattgaggtaaagtttatttcttttgcagtgtataacttacgatgttgctcttcggagaatgcaaccttgaacatgaccagcttggatgatagtgtattttttgattgtcttttcctgattttctgttaagctgtccatggctgtcagtgtcacactcagttggtagcccttgcttattattagctcagtgctctattgtttttgatagtgtctcggaataaattcctccataatcttacccaattaaattgggctcattttcaaggctatgttcattctaggtttgaaaaaaagagcaaatatcctgtggataatgaaaaccagtttttaattttgcaaaaggagttataaaaaaggtagcaaaatgactagaagaaattctttaatgctgggttggaattggaagtataaatacgtactcatggtttaatatgcacacacaaacacatatatacatatgcaggtagatgtggaaatagaagaagatgcatgtgtagatgtgaatataaatatacatatgttttagccatgtcaacgaagagagaaatagtgtaatagtagcagtgagcacccctaatactcaaatactggtatctagaaaactaaggcttcttaagaggattgtttggtttcagggctgggacaagcaatatacaagataaacttgtaatgtcttttttttaccaaaagctgagtaagtaccaaagaataatttgtatttgacaaagtacagttcagtcatcttaacagaaatactgctggctaaatatgtaaaaattaacattcaaataaataattgtagaatagaagtaaaacttcgtgaataaaatactccacaagtctactttgatatgagttataattttagtgaattataactcataaaataaaacaaatatgtgctggtcaatgttgatataaatacatgatttaatggttacatttttaaaaagaataattgttggaaagtatgatacaagatgttgaatgtcacttctgtaataacctcagattataaattttttcccaggcattaatttaacatcttcaattatctgtcattattttggtaaagtgacaactcgttgtgatttttttagtaaaaatttaaaactcttcattattttattatatattgtatttatattagaatatataaacaaaatgtaaaaacaactcaaatatcaaatttgaaacttatttcaaaatatgtatatgattctatgcctctttgaacattctttgcaaccaataaagttaagtttcccaaaattgtagcgctattaaacaactactaataacacataactaaaaattgcatgaatttaattttcatttgtaatttacaagcaattagaaaattatagaaaaacatggtgtgattattcttacaagaacagcaaataaaaaaatccattaaaaagtttttctgttagccctgaaataaaactagattgctcagttatatatttgttatattatacttgaatagcatatcaacttttattctgattattaaatgtccacataaaacttttaatatatggatatctaaaactactgtaaatattacaagtattgttttctttgtaaatagtataaacattattttgcttttattataaagtactcacaggtacaggtttaaaatcttccttacattttttaaatgtatttgtactttattgtaatatttttaaaggtcatagtaatttattttcaactcaagtcaaaatgtggcatattttcttctcagcacttatggaattatacctagggtttctatttgcatatacataagtttatattttttttaaaaaaaacactagaacttttcaaattaaattaaatataatggtgtgattttctttcaagtcctcaaaatagtgctgttttacataaaatgttgagtgttttattgtattatatcgctgacaaacttagaaactttttgatgtgaacagatggttaaatataatttatccatctaagaaagaagctaaaatacatgctacatacctatttttttaaattttcatttatattatggtttttactagtattctttatgcatctaattttttaaaaatcttcccccagagtaataactaagatttacagaaaagttttctctgtattcaatgtataattcctttagctcagtctcatctaattatcttcagcctttcatatttattaatcaacttagactgtttaaaagatttattgaatgagtaggaaatatgatccagtggattggactgggagaatgtattgtgaacaaacatgaaacttcagaaaaatactaccttcagaagcatagggaacttgctaaaagtatatgaatgaatgtggaaaaaagttagaaaaaaaagtgacgagtttaaaataattgggtttggagtcagatattcttggtttgaaatcatagctccaccatttgaagaatctcatgagctaaggtgaatgtcttaacctctttaaactttatctttcctatctgaaataatcattatttaggaaattgttataaataataagtgagataaagtatataagcatataaagaattgcttcctttattcaacaaatatttattgaatgcctgttttatatactcttcctagctctaaggatacagaagaagcaaggcagacatcgtttttactctcattaaaatcagccattgtgaaaattttaacatagacatcaggacaagatgattttgcaattggctgcaatctaatgtttaagaaacagataacttcaatatggtttaacacattctaggctatagaaccttaattattagaactaatacaaatataagaaataaaataaaattggaggtaaatttaacatatttctatagatgtaaaacttgaaataaattattatcatatagaatttactggttataaagtgttacatatataatgattaaaacttatttttaggaagttaaagataaatcaggtaaagaactctattcacatattccacgtattttattgatacaattttttttttctttttctgagacagggtcttgctctgttacccaggctggagtgctggagtgcagtagtgcattcatggctcactgcagccctggactcctgggcttaagcaatcctcccacctcagcctctcaggtagttgggactacacgtgcatgccacatagcctggaattttttttatttttcgtagaaactggctgtcactatgttgaccaggctggcccaaactcctgggctcaagctatccccctgcttcagccactcaaagtgctgagattacaggcttgatacaattcttaagtcaacaagttaagccaaaaagaaaaccagtatattaaaaaacttggaaattacgtttggaaaaattcatctgaacaacaaaaaaaccagcaaaattaaagccaaaacatctctaaatataaaagaaatataaataaatgattaaaatacaacatccagcagcaaatattaaaataaagcttgtaactgcaatttttaaatttacttatttatacattttgtttgtttgttttattgagatggagtctcactctgtcgcccaggttggagtgcagtggcacgatctcggctcactgcaacctttgccctccaagttcatgtgattctcctgcctccgagtagctggaattacaggcgcctgccgccgtgcctggctaatttttgtacttttagtaaagacagggtttccatcttggccaggctggccttgaactcgtgaccttgtggtccacccgcctcggcctcccaaagtgctgggattacagacttatttatatattgtttttgtgaaaaatcaagcataaggtatgaatgatttaatttcttgtcagatctcacaaattcaacatataaattagaatgtagttctaagtataactcgagttactgaattagataaatgccataaagttacacatggaagtctaatatttgtgcacagctataagatattagataagaatggataaagaaagaatggataaaggacttgattacagggcatgaaactgtattataaatatattgcaataaaatattggattgtcatagccatcaattagatcagtgaaactgaatatatggctctgcttttaattcttgtgctggtcaatattttttttaaaagttttagttcttaattcttttgagaatatgaggaagtgtcctcttatatttctggtagaattatgacttgtcacagcatttgccataatcagtccttcattattgaccaaaattagagtaaaacctactgggcaataaggaatccaaatgttttgactctattctgttaaaaaaagagagcaccagtaagtaacaatatacatacacagttgtttattataatactttttatgatgacagaaaatgactttaaataagctgtgtgactatcaataatttttttaaagaattgtgtttctcctctgtcatgacatgtcttgaagccaaaacaaacacaagtgaaaaattaagataaatatatattaggtaacctagagaaattttcattatgtgttattaaatagcaatgcaaggaatttgactataaaatgatgactgattataatttgatgttagatttgatctctattgaaattaatttgccatattgttcactttgtgtttataacagatttatgtggttatctgtatgtatacatgcatatactcgtttatttatcttttgtttattaaactaacatgtctgaagagcttcctctgtgctatgcactgttgtagcttttcatataaaggaaaaaagaaaaatccctgccttcatggctttagttaggtggtgatgggtattggggaggaaaagaaggcaagatattgatataagtggaggatgctgtacagtattatatagtcaatgccaacacattgatgcaacaatatgttatcttccatctctggttctagtccttgcagcagtaatactcctacatctgcaatctcatttactcatctttttagaataggattttctatagggcatttctcaagacaacttgactatttaatgatttgttatcagaatttgatctcaatgctgttagccaggaaaatttcccataacctttatttttgtaggtacgtgttataaggtcaaaaagtctgatcatctctgcataattataatatgccaaaatgtgtttcttatttattttttgtattcaagatgagttttcttatacacaagggatcattctgattgaaaactttttcacatagaatttctatgacttttgaaatatttaatgtaaattaaggggtttgtgcaagctgaaggctgtccaccttcattatatcgatgggctttctcctcactattttctgcgaccggggtgagaagtgaacttcttatgggcaatgtttttgttatctgtgaagcaccaggccattagttttttgcaatgacagaggaaaataatctaaccacctaaaaaaaaattggacacattttactcagctatagttgcataacaaactatgcaacaaaacctagcagattaaagcaatagttttaatttgctcactgtttgtggatgaggaatttaggaggtgcttagccaagtggctcacttttgtttcccatgatgtcaactaaggagtctcagtgcctggaggatccactttcaaggctcactcaagtgtctggcacattgattctgactttgtactgaggctttcgccagggataccaactgaatcatcagccaagggctttggttcctcttcatgtgaacctctatttttttccacatcttaccatgagaattccaagaagctgctaatcttttcatgcctagcctcagaaacccccaaaagaccctacagtcacattccttcttttaagtaagtcatgaatgtcagcctaggctctaaggtactcctcttggtaggtagtactcttgggaggagtactaaaaagtttaagccatctttaatttaccacaaaaaaacttgttctgtctctatttcataacatttacctgaagttctaatgtagactttcctatctgatataaatttagtttagttaatatcctgtgcctaaagctagaaaatatccattgtgtatactaagtatatttaaaaataacattttttgaccgacaaaacatttggaaggctatgtttcctcttattatattaataagaattataattcttaataataggaaaattttctatactttttatgtgctttaattcatttaatattcaaacaactctgtgtgcaagttagtattatctagattttcaagatgaaaagtgagatatagaaattctgttagtacattttgcttgctataaaaaataccttaggctgggtaatttataataaaagagttatatttggcccacagttcttcagatggtacaagaagtatgttgccaacacctgctcagcttctcgtgaggtttcaggaatcttacaatcatggcagaagacaaagagggagaaggcatgtcacatggtgatagaagcagcaagagagagttggggtaagggccacattcttttaaacaaccggatcttgcgtgaactcacagcaagaatttactcattactgctaggagggctccaaggcaccatatgaggaatctgctcccatgaccctaatacctcctaacaaccctcaccttcaacattgtggattacatgtcaacatagaaagtgtcagatctaagtttcagaaacaggcaatttgtttctatagactaaatatttaacatcctatttcttttataatattgaaacaaaacaccatgcattaaaaaaaatctgtctttaagtgtaccttgaaatctcatttcaaaattctgtctctttcccttcaggtaaatacctaatttaggatttaatctagctattgcttgagaagatatcacttgtgtttattttatatttattctacaaactataacctaattataacaatgatgatatctatataagctaaagaagcaagtctgcctttctttgtaagatacaacctttattttccttctaacagtttcatcaggattaccaagcttttattttggcattaaaaccattaaatgtcaataaaaagatacatgcgtttgtagtattttcagtcgttttgcgtttgtaatgttttcatctcgttttataaaagcttttctacaaagacagaattgttgctatgttgagaacactataaaatattttcagtaacattagaataaatctgtttacgtatttaagaaacatttgttacatccattggacacagaatgcattatttacaattagaaaaaggagataagaccgacacaaattaagaatacaagtcagtttattaaaaatatatataggagtgagtcaaatacattttcaactattaccatgataagaatttgaatcaatagatattatttaatggaataaagataaaatcaaatagtattaaacattataaaatgttttaggtctacttaattcttagttaatatttttcttagagtgaaattttatttgttttataatgctgggaagaaattttaaaataattatatttctactgtaaaacacatcttgtagaaatttcttagaagcaattaaaagcacaaaacctgttatagagtgaaaagggcagaatgatgtgctggagaatgacattttcatagcgagaaatctgaacagattttttagctgtacgtcatgttaggaaaacaggaaggatgcttgtctataataatactggtgatttgaatgcaggacgtatgttgtttgtgtagtatatggagcttaagagtattttattctatggatgccaaactggttttaatgtctaaagctcctgagttgctaagctgaacgtatgcatctaggcagtttacagtgttttacaagtgcaaagaaattttcttcagctgagagactgagactaatttttaatattataaaacctagcctggacaaatatgtatatttaattgataagttttaaattctaaaagtaaggaaaattacaacattattttttccttaggttgcagataacatagggtaaactgttttgatcctgtttaaattctggggtttattaaacaaaaaattgatcaggttgcaacagaagcttagatatttaaagtatgattcaatttgtaattgttctggagcaatacatattactgcctcttattgcatattttgatacctgaagtttttgttcacaaataagatgttataaaactggtaatattatttgccatgataaattcaataacctcaagaataaataaaacatagcccagaaacaaagaggggttgagttaatgatttagtttggatatttttctggcaatgatgaacaagcttatccaggctatttctgccatgtcaaagtgagtcatcaccgtagaatatctctatctgattatgggaattatacattgctccatctctggcttgttctgcctgctttagctcagaaagcaaaccatactattggaattacatagtatgtgactaactatgctgttcattgggtgagttatgtggcagtagactataatttatggattacttatgtcttttctattatgtaaaaaggtttatttccatcatcttttataatttttacacaactctatgatatagctttccactttaaagatgagaacatgaaagcttatagcttcatgcacttcataaaaccaggatttgaacattggtctacttcattctaatacctatttttaactgctctatcatagcacttacaaatgataattctctttccaaggaaaacatatccacagatgagctgagaagctagagcactctaattagagcctaccgttttatttccttgtgatacgtaaaagacaatttctttggctgtttagaaaaaaaattgtagcttaactttgaaaaaattgcataaaagacagtgaggtgataaacataatctggataatagttataccataagaaaaaacaaaaaagtgagagaaaggaaaaagaaaatttatatatagtgggttgaatatagtgccttccccaaattcatgtctacctagaagctcagaatttgacctgatttgaaaatatggtctttactaatggaactaattaaggatgtcaagatgaagtcatccttgattcatcctggatgaaataatcctcagcctgaaatcaaatgactggtatcattataagagaaaggagagggagatttgtgcacagagaacagggaagaagattatgtgaagagagggacagagattggagttctgctgccacaaaccaaggaagggcgggagcaccaggcagactctattctgaaggttggagagagaacatggtcctactgatagctttattttagaattctgacttccagaactgtcagaaaatgaatttctttgttttaactcacgtagttcatagtaatttattaccatagcccgaggaaatcatataaattattttatttcatacaatttggggattgtttcatgtacaagcggtgaaaaagaatagcctcctatttataaaataagagaaatgtgcctcactgtgtgaaatcataaagagtgtgttgcttttaataagcaaataaaagtactttggttatgtgtttgaataaagtgcctacacacacacacacacacacacacacacagatctcaatatatcacaacatgatttttgaaagtttaacattgattcaacaagcacaacagctacaatagggatgcacattaattactaagatgctccttaggctcagtcttgctttaggaagacttctctagatagatagatggatttgaaagggtatacctagcgtaattatattaacaaacttccctactgccagtatattcctacatgtttgtatgcacacacacacacacacacacacacacacacacacgtatagcagatagatcttggctgggtcaagtttttttttattcgtgcaggttagatcttatttaatcaatagcctaattggtttttagttggtttattctatcagctattggatgagatgggttaaagccttcttttgtgactgtggatttgtccatttcttcttttagttctgttaatttttctttacatatcgtgaactatggtattgtacacatacaaggttaagattgtgatatcatcctaaattgtagctgtcttattcttatgaaaggtttctcttcatctcaattaatttttattgctttagagatttatttttttagctaacattaaaatacacttgacgtttgaacaacatagaggttaagagtcctggcaatccatacagtagaaaatccatatataacttttgactcccccaagacttaactactaatagcctaccaatgactagaagccttatgaatgacataattgaatatatattgtaagtaatatgtattatatgttgtattttttaaaacaaaccataaactagagaaaaaatattataaagaaaataataaggaagcaaaaatatatttagtattaaaatatatttaatatttttaaatggaagtgaatatcataaaggtattcatccttgttgccttcacattaagtaggctgaggaggaagaagaacagcaggggctggttttgctgtctcagggtgggcggagggagaagagatggagaaggtagaagaggagcaggaaatgcaggtacacatgttgtaactttatagaaatgcatgttaatttctgtctgacacttttgcttttttgttgttccaaacatgtttctttacagtaccgatatttccttcaatatttaacttcagtgtcagtgtccatatcatagaaaggtccaggtcacaaaagaagtcaaaagcagtcttgaaaaattagaatcatgctgccagattgtatgatgtcacgttgttttctggcattcccttcctcatcatctggcacaagtttgaaagtgcttatcttcatcaagtcatcttctcttaattcctctggttagtgtctgtaagctcttgaatttttccaagatctctatcttcaaagctttaacctttcattttttgtgctgtatccacaatcttttttcataattttcttgatagactgtgttataaatcttatgaagtcatgcacaacatctagatatagctttccccagaaggaatttattgttttagttttgatgatttcatggctttttctataatgatagcatttcaatgacacaattctttcagactttcatgatgttctctttgttggaattctcttctagaacattgataattctttccatggagaaccttgtgtaatgagccctaagggtccttatgatcccttgatctagagaccgagttatagatgttgtatctggggcaagtagactacttccgtgccttcagtgttaaactcatggggttccggatgaccaagggaatgatgcaatatcaaaataactttaaaaagcagtcccttgctggcaaggtacttcctgacttcagagacaaagcatcaatggaagcaatacagaaaaaaattttcattgaccagactttcttgttgaacaaccaaaaaattggctgctagtgtttatcatttcaagaatcaggattagcagcctttgataagggcagtcttgattataaactcgattgagtttgcataacacaatacgattagcctaccatttcctgccttaaatcctgttgctcacttctcttccctactaatatgtgttctttttggcatctcctccccataatatgtcacgtttatctactttaaaaatcggttaaggcagatattctttctcttcaatgattttcttaatgacatctgggaattcacccgctgcctcttgatcagcagaagctacttcttctgttgtcttgtcatattttaagaaaaacaactttctgaaattatcaagccacacgttgctggcattaaatactacagctttagatccttccccttccttttgctttaaatggtcatataatgactttgtttttcctgaatcatattagattctttaggtatgcctttcttatagcaatcatgcacccaggtaaaagctgaattttcaatatgagataaaaaggtatttcacaaaaagtgcaaggattttgtgcctgctggcatagctgcagcaatggcttcataatgtttcttttcttttttttttttttacaatggtcattatagtggattcatttatcttaaaatggtgggcaactgcagctgcggacttcaatctttcttgtgacgtcatgacttttctctgcttcttggaagtgcttccagcatcactaatggcatttggtagaggtcccatggtgttatttaaggcttatggtattgcattaaacaccatgaaaagaaagagagagaaatatgagagatcaccttttaactgcaatatgcaatttgctgaatagacaattggtcatgtatagatgattaaggtcacatgacattttaatcacatacttgtaacatttgaattcactaccatagcaacaagaagtggctatgaaattatgacagtagtatactatgtactacagttgattatatgcagttatgatttaatgctgcatttttacatttgttaattctattttaacctttgtattacttttgaaatgcattgtacttcaagaaatatttaaaatctctatgacactatttttttcagttttattcaattattatgtgtttatatttacacatatatgagcactttctcttcactatttcttgcacttttctggaatcactttcattcttctagaggaactgttatgtattttttattgccaacatgtttgaagattaattcattctaaaaaatcttttctaaaaagtgtgtttaatttgtgttcatttaaaataaattttcactggctataaaaatctagattgaagtgggtttttttcagcaatttaaatatgtcattctgtattatggtcagctcaataattactgagaaatcctttgaagatattgaaaattttttccctcattgctatttttcactcaatatttgcttggttggttaatctctggttgcttttattttttattatttcttttgaattttcaacaaatataattaaattatgatttccttaggtgtaaataacattcagttggagaaaagttatggcaggtccaaaacaaagacttgggttggatctgattttacttaggatgacagaaaaaatggaagaatgtattttaaataagataataaataatgtaaatataaaaatcatggttatatatacatgaattttattttacaataaggtatactttacaagagatttttgttaaaaaatgggaagatatcaaagaatattaaaatttggaaagaaaatagtaggtatatagagaaaatgggtagaattatttttcactttcttctgcattacttctaagaaaaagtaatttggatgagtaactcatccaaatgcaatgaaaacctcaatttattctccaccaatttaccctttaataaaataaattccaatgatagctgatttattttgtaatgtctcaaatggacaagtttgatatatatttttgaagtgaatatccaggacttcatggtggattggatatgaaggggagcaagagaaagagaaagaaagagcagaattgaaaattaaactaatatttaattgaccaacattattgttggtcaattaacttgaccaactgagtaaggtgatgttgtttgctaaattgaagaccgtggtggggaaacccatttgaggtaggaaataatgaatacatcttggatatgttaagtttgccatttgtgtgatttacacaagtggcatttttgatataaatatattattcaaaggaatgtctcttctttgggaaaataaattgagtcatttacatatgattggtgtttcaaataccttattcagttgcatgcactcaggacaggttaagagaaaggagcaaagagtctcaataccaaacactctggaatttagagatcaagactaggaaaataatctcaaatctctggtaagagagtaatgatggcagtggtggctcatctggaggagctgctgccatgacaccgtctgcaataggggaggtgtggcagggactgtgggcaccacagagcctgagggagctaggaacaggcagaagccccacctgcttcctagttggcagggtgtgagcctcgtgctccctgggcacagctgctgggggcccagccatggctctggaccaggacatccctgtgctcttggaggctaggagcaggcaggagctctaccatcctgggtgaagttgtagctgtttggccacaggtttggaagtgcctgctcccactgcctggcctctttctgttcccagtgcccgctctgatcttggaacaaagttaaggccaagcttgggtgctatcacaacctggccaggtgcgcccaagctcgagacagtgctgacatgccagcctcctgccacctcagccccctctagactttgggtgccgataagaccaggaaggagcctgagggggcactgagggtggcttggcacaggcctgcaggtgccccttggcacagcttgggggatggcaggaggcagacaggctcctgggtagaaaaaggtaagtccctggtgaagtcccaccttcaggccatggatggcctaatgcctgggggctgggttgatggatgcgaatgggaaggcatggtgccttttctgggcctacccatggcagccattgaacaaaacagcatgtactttctcccctctgaagcccataaaaatccgggattcagccagacttagggagatgacctgatgaccagctgtggagaggagctacccactccagagtcttctatctgccaagagctgggcagatattgggaccaccagctgtggagaagagctacccagtccagggtttcctctctgctgagaccttagcagatgtcgggattaccagctgaggataagagctccccactccagggcctcctctctgctgagagctgagcactcgttgggacaccttgcctctggagagtagcgacccactgtgggtctcctctgagctgttctgttgctcaataaagctcctcttcaccttgctcaccctcaacttgtccacatacctcattcttcctggacacagggcaagaactagggacctgttgaatggtggaggtaaaagagctttaacaaaaacagggctgaaactccccgttgcttgccacactgtgggcaacaagaaggagagaagagagaaggagagaacatctgtggccctttggagagcacagacctaggagctacccaagccagggctgtgatcctctctctggagcgctgtggttcctggagtcttcaagcttccgggtgccgcagcactccccatgccaaccttggaagcagcttgtgatatgtctggttcagctgcagtctcataaggagctggcatccatgccagcacctggggttgcctgtcccactgcaggtggcgtgcctgactgtgtgcagtggctggaccacctgcttgctcactcacacattcctgctgctttgcacctggcttgccccctggaaggcatgagattctagcccgtaatgtgagtctagtgctgcctgccaagccaagtgggtagaacaagcccaggaggccccagtaaaaacttgggcaaaggaaccactggccgcagaggtttctggctggtaaagcaacaccccagggatcccataatagtaaggaatcacaatcactaaaataaaagagtgtttcaagaacaaagcagtgttcaacattgaacaaagaacaaaggagtgtgtgaattcaggttaccaaagtgcccattaagcattggagccataacaaaagcaaaaattgacaaatgtgacctaattaaactgaagaaattctgcacagtaaaagaaactatcaacagattaaacagacaacctacagaataggagaaaatattttctaactacacatctgacaaagatgtaatatccagaatctataaggaactgaaacaatttaacaaataaaaaacaaataacccatcaaaaaatgggcaggtatattaacagacacttttcaaaagaagacatacaagtggccaacaaacatatgaaaaaatgttccatatcactaatcatcagagaaatgcaaatcaaaaccacgatgtgataccatctcacaccagttcgaacgtctattattaaaaagccaaaaaataacagatgctgaccagccttcagaggaaagaaaatacttacacattcttagttggaatgtaaattagttcagcccctgtagaaagcagtttggagatttctcaaagaactcaaaactaccattaggcccagcaatcccattgctaggtgtatatccaaaaggaaacaaattattctaccaaagacacatacacttgcatattctttgcagcaccattcacactagcaaagacatggaattaacttaaatgcccatcactggtgaactggataaaggaaatgttgtatacatacatcatgcaatactatgcagccataaaagaggacaaaatgatattctttgcagcaacatggatgcagctagaggccattatcctaagcaaatgaatgcagaaacagaaatccaaataccacatgttctcaattataagtgggtgctagatattagatacacaagaacataaagatggcaacaatagaaattgaggactgctagatgggagaggaagtgaggagggcaagagttgaaaaactaactgttggatactatgatcaatacctgggatcactcataccctaaacctcagcatcatgcaatatacccaggtaataaacctgcacatgtacccctgaagctaaaataaaagttgaagaaaaagaattggagccatgaagaccattaacaactttcacaagagaagttgtaggaatgtggtaagggcagaaatgcatgtattgagtttaagaataaaaacgtgacagaatgaaaagtttctttggaaatgtttgttttgaagcaattatagaaaaatgggatgtggaacaaccgaagtgtcaaggtagagtctatataccagcaaaagcgtgcctgtaagctaataatagtctattctggagaataagagggattgatagtttaaaaatgaaaatgtggctgggtgcggtggctcatggcagtaatcccagcactttggtagccccaggagggcggatcaagaggtcagaagttcaagaccagcctggccaacatggtgaagccctgtctgtactaaaaatacaaaaattagctgggcgtcgtggtgtgcacctgtaatcccaaccactcgggaggttgaggctagagaatctcttgaccctgggaggcagaggttgcagtaagccgagaatggccactgcactccagcatgggtgacagagcgaatctctgtcatggaaaaaaaaagtgaaaatgtataacagaagtgttaaaatctttgcatccatagcacaagatacttacgtttgataagcagagagccacgtagtctttgcaatgctattgtaatttattcaaataataaaagaggtatagctgtgtatttggtagtgtaaagtaacagaaaaaaatgttaaggcttatgaattgcttaggaaatataagacaaggtcagaagctaaatgatgcatgagaagactaataagtgagaaatataaaaaatagttatcatagagagtaagagcagatgctgtagagaaagaaaataaggttactaagcggtactgagtgtccatggaaattggcgatcatgagcatatggtgagaccattttgtgtagggtgtgatttcccctgcaaaattttctacatatctgcatgtatgaaaaagattggtaagttcctccaggaaagaaaaatttccatgtgattgtgaaaaagataagttgcaatttgtaaatttttgaaggaaattgaagatctcagtggtgtcaagtgattaatacagttaatgcttgtataagaaataggttatatttgaagatttttcaagtaaaaataggttttgaaggtaatacaatttttgctaattataaggtttatgatataatatgaaaatataattggatgaaaaggagataaaggtcattagagatctagaagtcaaggaacttagaggcaagtgggcagggtgaactaatcatatgtaagttgaagtttacaaagaatagaaaggttagtaataatataatgttgaaaaagataagagagtctatggttaaccccctacccccgaatgcaaagatgatggcaaagctgaatgtcatggacttaatgaaggacttttacaagcagaggaaacaagtggtttggaggtaaccctgaattgcaggaacactaaccctactttacaagtttgatgtacatggcatgagggtaaataatcaggttacacttaagagaagaaactcccttatcaattaagatgggagaaaaaatgctatgaaagaagatgaagattgatagaatgatctggtcaaaaacaggaatttcctggggcatagtggagcaagtttggaaggaagggaagaggagtgagaaggggatgataaaaaatatgtagaatgagataaaagaaaataatgcataccttaggagacttagacttctggtagagttgagataggtgagtattatgaatatttttaatggtttccatgagaaattatcaaggtatagtgaataaaataggcaagtctcagctttgagctcatgttgtagcaggcaatggcagaatataaataactataagatatgtggtgatagtgctgtggacaaagataaaaccagatgcagaatatggtgcattaaagtagtgagagagtgctattttacattcaatatctggggaaaaccctctgttaaaatcaaatttgaacagagtactgtgagtatggggattatgatatgcgataaagaggggaggtggttgggagccagaacatggaggacctaaggaactgctgtaaggcctttgacatttattcagaatgaatggacaccgctgaccgattttaagcagaatatctgtcagatattttagaagtggtattctgacggctctgctgagaatgagaaaacattttttactggatagattttgaaggcagagtcaacatcagttgtgctgcattacaagtgatgcagaaaagcaagaaaataaccaaggagacctctaaatatgtgtgagagttttcctcctgttgaacagatactctatatcgagatgagaaagaccgaagtgcaggtttgtgggtgggaaacagaaggtttattttattttattttattttattatttttgagacagagtttcactcttgttgctcaggctggagtgcagtggcaccagctgggctcactgcaacctccacctcccgggttcaagcgattcttctgcctcagcctcccaagtagctgggactacaggcacacgccaccatgtctgtaatttttttctattgttggtaaagacggggtttcaccatattggccaggctggtctcaagctcctgacctcaggtgatccgcccacctcggcctctagaagttctgggattacaggcgtgaaccaccatgtcccacagaaggttaattttagatatctaggtggaactgataagtcagtaggctgttaagtggattggtataaactggggatgtaatttggaagtaaatagcatatagtggtttttatatccatgagagtggtggaggtcatgtgagcagtctgtgtagtttaagcaaaggaattacaaaatgaagcctatgggactccatattttaagggttagacggtgaggaaggtccagcaaagttgttgactaggaatggcttaagatggaagaaaactaacagctgcaaacatgatagctgtttcttccctttcttccatcattcctgccgttattttcctcttcctctttattcttagctcacttattttcctccttccagttttagcttttttcctctctaattttacacgtctttttctttccttttttgaggggttgtttttatttgagaaatagtttaggaaatgccttcattgttagatgctttatttatcactaagatttcagatgttttcttaaaaaaccacttaaggaattactggaattctgatagttacccatttaatatggtttatgtgtaagatctctctttaagcatttttctctagtatgtgttggttaaaaaaaaacatgaagaatcagctctttgcaattatttagcaagatttaggcaaagcctttcaaagtaattattacggtcttgatcaatgtgattaattttctatgtgacagaaacttggaattgaagagcaatctttagaaaaataaatttgcagtgacacaattgtataatttgtaaatgattaaaaatggataatagtttgcatttatgaaggagaattgttctgagtggttttagaagaggaaaataacattccacaatttaccaaaaatataaaatgtctgattgaggaaatcattttgaattgctattaaaaattttcaaggtgccattaaactgaaatgtactgtatttgaaattgtagataaacccagtcctatacgtttgcatcactatttatgactcttttttgttgttgttgctgttttcttttcttggaggctaatttaacagagattgaagctaattttggaagaaatattctgattttcttattattcttcaaattattattatttaaactcactagggagcatctgacaaaccattgtaaaattttgctatttgagagctaaatacgtctcacatataaatgaagctatgtaatggtaatataactctggaaagctgattattagaaataataaagtctcaggggaattgagaagccctaaactatgttttgagaattagaatagctcaaggccataatgttgcctggctactgaaacaataatacactcatatcgaatcactgccacttagagaaatatgaactatctttaagtttcagctcaaattttattttaaaaaagaacatcaccatgtttctctaaccatagatgccactaatttatacaataaacaatttacaattagatacttaaagttgttttgttataaatttaattttaaaaaattattcagaattttaaatactcattttcataaataacttcataatgctttattgtatacatattcatgcatatataatatgcatttaaatattgtgcatataattaattttaaaatatcttaaatgttttttttttctggtgtcattttttttaaattttttttatttttattatactttaagttttagggtacatgtgcacattgtgcaggttaattacatatgtatacttgtgccatgctggtgcgctgcacccactaactcgtcatctagcattaggtatatctcccgatgttatccctcccccctccccccaccccacaacagtccccagagtgtgatattccccttcctgtgtccatgtgatctcattgttcaattcccacctatgagtgagaatatgcggtgtttggttttttgttcttgcgatagtttactgagaatgatgatttccagtttcatccatgtgcctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcttttgggcatatacccagtaatgggatggctgggtcaaatggtatttttagttctagatccctgaggaatcgccacactgacttccacaatggctgaactagtttacagtcccaccaacagtgtaaaagtgttcctatttctccacatcctctccagcacctgttgtttcctgacttcttaatgatcgccattctaactggtgtgagatggtatctcattgtggttttgatttgcatttctctgatgaccagtgatgatgagcattttttcatgtgtttttttggctgcataaatgccttcttttgagaagtgtctgttcatgtcctttgcccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctcaccagttttcccagcaccatttattaaatagggaatcctttccccattgcttgtttttctcagatttgtcaaagatcagatagttgtagatatgcggcattatttctgagggctctgttctgttccattgacctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcatgatattgattcttcctacccatgagcatggaatgttcttccatttgtttgtatcctcttttatttgcttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttgaggagattttgtgctgagacaatggggttttctagatatacaatcatgtcgtctgcaaacagggacaatttgacttcctcttttcctaactgaataccctttatttccttctcctgcctaattgccctggccagaacttccaacactatgttgaataggagtggtgagagagggcatccctgtcttgtgccagttttcaaagggaatgcttccagtttttgcccattcagtacgatattggctgtgggtttgtcatagacagctcttattattttgagatacatcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttttgttgtgtctctgcctggctttggtatcacaatgatgctggcctcataatatgagttagggaggattccctttttttctattgattggaatagtttcagaaggaatggtaccagttcctccttgtacctctggtagaattcggctgtgaatccatctggtcctggactctttttggttggtaagctattgattattgccacaatttcagctcctgttattggtctattcagagattcaacttcttcctggtttagttttgggagagtgtatgtgtccaggaatttatccatttcttctagattttctagtttatttgcatagaggtgtttgtagtattctctgatggtagtttgtatttctgtgggatcggtggtgacatcccctttatcattttttattgtgtctatttgattcttctctctttttttgtttattagtcttgctagcagtctatcaatattgttgatcctttcaaaaaaccagctcctggattcattaatttttttgaagggttttgtgtatctctatttccttcagttctgctctgattttagttatttgttgccttctgctagcttttgaatgtgtttgctcttgcttttctagttcttttagttgtgatgttagggtgtcaattttggatctttcctgctttgtcttgtgggcatttagtgctataagtttccctctacacactgctttgaatgcatcccagaaattctggtatgttgtgtctttgttctcgttggtttcaaagaacatctttacttctgccttcatttcgttatgtacccagtagtcattcaggagcaggttgttcagtttccatgtagttgagcggttttgagtgagattcttaatcctgagttctagtttgattgcactgtggtctgagagacagtttgttataatttctgttcttttacatttgctgaggagagctttacttcccagtatgtggtcaattttggaataggtgtggtgtggtgctgaaaaaaatgtatattctgttgattggggatggagagttctgtagatgtctattaggtccgcttcgtgcagagctgagttcaattcctgggtatccttgttgattttctgtctcgttgatctgtctaatgttgacagtggggtgttaaagtctcccattattaatgtgtgggagtctaagtctctttgtaggtcactcaggacttgctttatgaatcttggtgctcctgtattgggtgcacatatatttaggatagttagctcttcttgttgaattgatccctttaccattatgtaatggccttctttgtctcttttgatctttgttggtttaaagtctgttttatcagagactaggattgcgacccctgccttttttttttttccattggcttggtagatcttcctccatccttttattttgagcctacatgtgtctctgcatgtgagatgggtttcctgaatacagcacactgatgggtcttgactctttatccaatttgccagtctgtgtcttttaattggagcatttagtccatttacatctaaagttaatattgttatgtgtgaatttgatcctgtcattatgatgttagctggttattttgcttgttagttgatgcagtttcttcctagtctcgatggtctttacattttggcatgattttgcagtggctggtactggttgttcctttccacgtttagtgcttccttcaggagctcttgtaaggcaggcctggtggtgacaaaatctctcagcatttgcttgtctgtaaagtattttatttctccttcacttatgaagcttagtttggctggatatgaaattctgggttgaaaattcttttatttaagaatgttgaatattggcccccactctcttctggcttgtagggtttctgctgagagatcctgttagtctgatgggcttccctttgagggtaacccgacctttctctctggctgcccttaacattttttccttcatttcaactttggtgaatctgacaattatgtgtcttggagttgatcttctcgaggagtatctttgtggcgttctctgtatttcctgaatctgaacgttggcctaccttgctagattggggaagttctcctggataatatcctgcagggtgttttccaacttggttccattctccccatcactttcaggtacaccaatcagacgtagatttggtcttttcacatagtcccatatttcttggaggctttgctcatttctttttattcttttttctctagacttcccttctcgcttcatttcattcatttcatcttccatcgctgataccctttcttccagttgattgcatcagctcctgaggcttctgcattcttcatgtagttctcgagccttggttttcagctccatcagctcctttaagcacttctctgtattggttattctagttatacattcttctaaatttttttcaaagttttcaacttctttgcctttggtttgaatgtcctcctgtagctcagagtaatttgatcgtctgaagccttcttctctcagctcgtccaagtcattctgcaaccagctttgttccgttgctggtgaggaactgcattcgtttggaggaggagaggcgctctgctttttagagtttccagtttttctgttctgttttttccccatctttgtggttttatctacttttggtctttgatgatggtgatgtacagatgggtttttggtgtggatgtcctttctgtttgttagttttccttctaacagagaggaccctcagctgcaggtctgttggagtaccctgctgtgtgaagtgtcagtgtgcccctgctgggggttgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctctgtttacctaagcaagcctgggcaatggcgggcgcccctcccccagcctcgctgccgccttgcagtttgatctcagactgctgtgctagcaatcagcgagactccatgggcgtaggaccctcggagcgaggtgtgggatataatctcgtggtgcactgttttttaagcctgtcggaaaagcgcagtattcgggtgggagtgaccagattttccaggtgccgtccatcacccctttctttgactgagaaagggaactccctgaccccctgcgcttcccgagtgaggcaatgcctcgccctgcttcagctcacgcacggtgcgcgcacccactgacctgcgcccactgtctggcactccctagtgagatgaagccggtacctcagatggaaatgcagaaatcacccgtcttctgcgtcgctcacgctgggagctgtagaccggagctgttcctattcggccatcttctctggtgtccaaaatatcttaaatgttttgaccatccatgccctcaaaggtcatcatgtgagctgatatgttatttaacttgattgtggtaatcagttcacaatgtatacatatacccaaaacataatgttgtgtacaataaatatatagaatttctatttttcagttatacctttatatagctggaaaaatattatgaataaatatttaatgaaagtttggttgaagtccatatttacacttctcatgtatgctaccacataaaaatatgtgtgtgctgaaaaagtactaagtttgtaaatagaagaacttttaaagggtcacttcctatcctatcctagcttttaaaatttgggtagatcactttatccttggaggttccattttttatctgtaaaatagaatcagagattctcttttatatatttaaaatggctgttataaggctgaaatttggtctttgaaataatgatgaaaaaatacataaaatttataaatgcattagaaggggaaagaacacttctaaagtcaaatatgaggtctggactatcctaaggccaggcactgactgtacaagaaacacatgctaaagactatgttttatgagtatagacataaatatcttcaacataatattagcaaagaaaatgagcatatagatttattcagtctatttattctctacctataaacaaatgcatataaattgaaaagaaagaagtaaaattacttctatttacagattgattgactccagagtttggaaagtttcaaaaaatctacaaacattccaagaactagtaggttcagaacagtttcacgatataagatgaacgtacaaaagttaattgcatgtccatgtaatagcaacgaacaattggaatttaaaaaaaatccactttaaaaccaaaaatatacatataatatgtatgctaaaaactacaaaatttgcataaagtaaatcaaaggatacataaagggagcaatatgcagtgttcatggagcagaagacacaatacttctaaaatattattttttttcaatcaatctatagtttaattctaatctcaataaaaattctagtaagctcttttgtggatggtgacatccacaagcagatactgaaatttatattagagagcaaatcaacaggaatagccaaaacgattttgaaaagaacaagttggagaattcacacttgaggatttcaagacattctaaaggtacagtgatgaaaacactgagtttgcagaacagtagagtaaatgtgtgtttattgatgaaacgaatgtatattcatgaatgtatattggtaaaaagatacacacatagatcagtgaaacagaacggagtgcagagtagacccacacaaatgtagtcaactgattttcttttcacaaagttgaaaggcattttaatggacaaaggatcgttcctttcaacaaatgagtgtgcaataattggaaacaaacctcaacaaatacctcacaacttaaacaaaaattaactcaaaatggatcttagacttgtgtggaaaacctaaaactatacaacttctagaagaaattgtagatagagtcttgtgactttgggttagacaaacagtttttagctatgatagcaatgcacaatccatataagaaaaaatagaaaaattgaaatttataaaaataaaaatattttgatatttgaataataatgcttagatcagatttctcaaaaagacttgtatccacaatctatgaagaagtctcaaggcataatgtttaggaaacaaatattttattaaatacatgagaaagagatttaagcagacacttcatcaaagtagatatttagatgacaaatcagcatatgaaaagatggctcgatatcattagccatcaagaatatgcaaaataaagccaaaatgagaaaccacttgatatggtttggacctgtgtcccacccaaatctcatgttcaattgtcattcctaatgctgaaggtggggcctggtgcgggatgattggatcatgggggcagtttctcatgaatggtttagcaccatctccttgatgctgttcttgggattgtgagtaagttcttgtgagacatggttgtttaaaagcatatgatacctttcctcacccaccttcctcctgctccagccatgtgaagtgctggctcctgcttcacattctgccatgattgtaagtttcctgaggcctccctagaagctgagtagatgccagcatcatgctttctgtacagcctgcagaattgtaggccaattaaacctattttctttataaattacccagtcttagctacttctttatagcaatgtgagaacagactaagacaccaccacatggctattagaatggctaaaatttaaactgaataaatgaccaagaacaaactgacaaataaacacctgacaattacaagtgctgacatggatgtgaattaactggaattctcataccttgctggtgaaaaactaaaatggtacagccactttggaaaacagttttgcaatgttttataaagttaaccatacatttatcatatagttcttcaaaccccctcctaaatatttcaagagaaataaaaactcatttttacacaaaaatctgctcagaatgtttatagtagctctatccccctcaaacacaaaataactctgtgtatatttaactgataaatatgcaaacaaactgtgaagcatttatataatagtaatacttgcacataaaataaaaactattaaacatgcaaaaacatgagtatacttcgagtgtaatttgctaagtaaaataatccagattcaaaggctacattgaatactttcatttatatgacattgtgccaaagacaaaactatagaaataaaaggcattgttagttgccagctgcagttgaattgagtagaaggggatactagggaaatttggggggattaaaatgttttacattttgattattgtggtagttactagacagtgtatgtcaaaaattcagaaatagagtgtactatatattagatcttaataaacctgagtaaaaaagtgtaaaaagcactacttaaaacatttacttgaataagatttaatataatttctgttaggaaactatttcttaaaaagaagaaaagaagtcataaaagagtgacaaatttcttattattaaattttaaaatattattcatcaatggataccataaaaatgaaaaaaacagactcgaaattggaggaagttatttaaaacaatctatgcaaagattaatacacagtgtatatagtttacaaaagataacgaaaaaatcaaataaaacatgaacaaggcatacaaataggcatttttttaaaagaggaaaatggaaaagccaataatcacatgaatggacacttaatatgagaaaagttaaaaccacaattgataatattttatgggccaaatggccagggactgtgggtggcctctatgatctgagagctttcttcatcaagaagctgaaatcttcaatccgcaaccacaaaaccgtggaatctgccaataaccttgagaatcttggaagcagatctttccccatttaaacctcttatgactgcaattctcactgacacatggattgcaattcagtgagactttgaggcagagaaatcagctaaattgtgtgccagggcttcttaccgatagagacggtgagatcataaatgtgggttggtgagatcataaatgtgtgttcatttaagacagaaatagaaaactaatataatctttattctcagtttattcaaatctaaaatggagacaataatagtatttatctcacagggttatttaatcaattcgtttgctactggactcatattgaatttgataaataacaggtatagatccacttagagactttaggtattaggttgttgcaaaagtaattgcgggtttcgcgattacctttaacgatgaaaccacaattacttttgcaccaacctgtaggcactttttgaaaatgggttcctctaaatctaaggaatctgtgactccactttttaggacacgagataatgttatatatatatatatatatatatatatatatatatatatatatatatatgttaatggcccaggacctgtgtaattttataagaatgggttaactctactacatgcaacttagaattacagtggccacaatggggaagttttaagtcaagaggcacactagaaaaaaacaattcaaaacctaaaaaaaataaaatggaatatatttctgatgggcattcagaagtttctaaaagactaaatgaataaaaaacaaaaactgcctctcttaaaaagagaaatgagaaatcttaaaagtcttttcataaatattagtaaaaatctttggccatctagctgagtaaccttgttccatcagccagaaaaaaccatctggatataatttttaaaaaataaattagtgagcttcatattactgtacttggcacatagctacaatttaaaaacgaaaactataagatctccttctcctcctccacaagaaaaaagttataaaataaaaacagaatggatgtaaaaaagtgtagaagttttgtaggaaatgagccttgtgataggaaacttgtgtgtgactaagctaagacttgaacatacactgtttttaaactgagcgttaatatcaaaagaacactgatgcaaaactagaatctggttctctctgttaaaacaaagtttgcttggcatattgatctgcaatgtaggtttctgtatttgcctttgaagcctttgaaatatcactctggtcaaataaatattgcttcacagcgacttgtgattctacttaaacatgtgttttaaactttttgacattcttgacaactttcaaatataaaattctaaattaagtccttttgaacttgaactaaccttgggaatttctagtgaggtcctggtagtatctcaacagaatttgttctctctccttataaaaagtgaaatgttaaactaattagatttatttgatatgtttaattgcatggaaagtaccatcaaataaaaagtgatgttgaatcttctttaaatcatattgtataagtatgtaattaatatgttttagaaattttataaaattcctagaaatctgataatcctggcaaaatgctttcagtcttaattctagttgtcttaaaatattgttatgttgcagaagtaataaaatttccttattaatagcattaaaataacctctcatcagatctttgaccatagctactttaaggcttgtcatccacagacagttaattgttttactctgacactttcctgaaagctattgaaagtaactataaaccaaaagtgttttctctttgaagtgaattcttagaatgaattctgagaagtagaagtttccgataacttcaagatataccattggtttgagtaagaattcccaaaactaatggagaaactgattggttcataaaactgaaaacacaacatcaaatagaacaaggactaattaaataccaaggaaataaattttcattataagtcatctagaactgaaactgttaagatatgcaatttgtatgaactccataaaattgacccaagtccagtgacctatgatagcctatttaatacagtgctatttccctgattcaaaaaaaattgctatctgaaaggatgtaaatttaatgttaagtactgatttatagagggcctggaaatccacttagtccttgctgaatcctaagcttctattattaaaaactgttctccatgactcatcgagcagataatataatacaaagtatgaaaaaaaattgttgtgttcacggttttaaatttatgaaaatggtttaaaaccaacgtttggtttgtcaagccagaatcctaggaaggcaataaaaacttcagatggtacacaggtggtaagtttttgccacctgttggaaatttgaacacttacagatgggtttctttcaattactaaccataatgtaatatcatagtgttcttgtaatagtctgaatgttctctgaatggatagaaacttttccatgtaggatggctgatgctagaaaagtagttaaaggtgattttaaaatgtgtttctacacacatttttaacacatcatgtgatttcacgtgatgagttataaaacagttataagatattaaaaacacaatggtattaccatccttctatcatgttcaatcttctaggagtattaaaaggacaaatgatgttttaaaactgaaattatcagttaactgaattgactggattgccttggccacaggtattaccattggccatgataaccatcagatccaccctactggaaaacacaattttacccctcaaccctttataaaatagctattgagatatctatatctttaataatataatataatgtattgctcattctcataaacttgaatatgcctacacactgcggggctttaatgcatgatgcctatgtatattttcaccaggtaaatgaagccttccatgatgcaccagcagatgacaacctagaacctagtcattcacaatctagaacttaaaaatcgggtcttttgtaaatgacaccagagaaagatgtcccttgaatgctattgtaagggaccatatcaagttcttctcaccactcacactgcagcaaaatttcaaggccttgaaccttaggttcacatctctcaactcaaggggggcctttcacacacttgggactgtatacccattggaccagggaggtctcttcccaaaagcaaatgacattctagatgtggacagctttctcaagatcatgaatcatggcttctctctgctgtcatcatggaaactttgttattttttctcattgccccatgccatctttttgtttatgtgtggcaatatagttccatggttaatatatcacaatcaatatattctggaggaacttaactaaattctggatgtgtcatgccaaacttaaatccctacataatactaaagatcctctggttcatcctgtaacaaatttcactgatatttcaagtgtgactatcttttaaatctgcacatcttgtctttttttattaatataaagctgggcttttagatccacatattcaaatcccttgcttaaatgtaagagtagtcaaaaaaagctatagtgagggtttttcagttgaatatgctgaaaactgaataagaaaatgaaagggaaagataatttgacagttggtagagaaattcatcatctttattctctcattgttggttgcctttgattttgcaataattcatttacttatccttggataaaagtaccagtttatccttggataaaaagtaccagttttttcctactaatgacccctaacatacaaggtgtcccacagttgttctttgtgcccctccgagaactatttttgcctatggaggatttaacaataagccatataaaagggcaacttcactcaataagtaggaaataaatgtctcaaaaaggcagaaataagagattattgtaaaataggaattctaacaatactacaattactccataatcgaaaactgaacattggtctatacatcttaatttgcactatagaatacggaagaatgtgttaatttctctcaattacatcttttggtatatgcttcctgtctcatatatatatatataaaattatgattagaaatctacttcaaacattaggtagtagagctgactctactcataaagactatagttgttcaacagaatcatgtaaactcccttgaaaacattgtgttagatgacaagactgccttagactgtcggttggctggagaaaggaaagtgtgtgtaacagctaacacttcctgttgcacttggatacatatatctagtgtagtagaaactcagttgtaaaaaaaaaaactgacaattcatttgttttaaataaatagatttatcttctggctgattctttgatgtatttgtttttaatcagttttgttcatgggggcctcggttaaagagcacgtttcaaccatttgatattatccctaccaggtagtctccctagtgagctatatcctcataagagtcttaaatgtttgtatgtagccatctactgtgtgtcaaacggtttcactccggttttagcaccaaaaacttgaaaataacataagtaattactcaactaacttgacatcatgacttgtaaattccataacaaataagtccctttcgatggtaacagagaatgtcatcaagacccaagtttttggtcagtttctcaagattgagagactgatcaaaaggggagggttaataaactaaaataaacaggaagccattaaactgaggctgcctctgtatttccagtttctatgtaacaaagtgcaacctaacttagtacataaataaactgaaacctaacttaacttaaagcttaacttaaaagtatagtttcagctaatcccaaagagcaaaggttcagccaatcccaggcagccaactaattatactatgtgcaaataaggcaaatgcctaaaccatgcccctaaaagacagttccctagctatagcaaatccagtgatttacccacttttgtttctgcgttctactgtaaaagctcactgctcatgctgctgggcagaagtctctgaaccgtttttggttctgagtgctgcctgactcataaattgtcctttgctgaaataaactctgttcaatttaatttgtctaaagtttagattttaacaccaaagtatagacctttttttttttttgccagaaggaggaattatgtgttttaattttacaaagacttaaagaaaatctttggccaggtgatgagtaagttcaacattataaaaagcgtaagagaaattctgacctttctgtcatagagaagttgctgaaaagggcaaacctctgtcctaaaagatgtcatggtttcacagaaaacagagtaaaaggcttgtagcttgttgtagcagaagaatgcccattaccatgtacataaccatgtacagcaatgcccatcacacatactagggcctttttccatttttttagagatgacataaatctcctggaattctgtactattcagtataaatggacaggaacacccaagattgacttaatccacatccatcttagtattattgatgagtaagtgaggtgctcacatcatattaatttagaaatttaaattatagttacctttcctgtacattagttttgtaaaataaattcttatttactaatatattggatggctgcaaataagaaaagtatgtcattgcttgggtgcattggctcatgcctgtaatcctagcactttgggaggctgaggcgggcggatcacctgaggtcaggagttcgagcccagcatggccaacatggtgaaaccctgtctctactaaaaacacaaaaattagctgggcgtggtggcatgcgcctgtaatcccagctactggggaggctgaggcagaagaatcacctgaacccaggaagcagaggttgcaatgagttgagctcacaccactgcactgcagcctaggtgacagagggagactccatctcaaaaaaataataataataaaaataagtcattggggaaatcgggttgaaagaaggcaagcagattgtttaaataagaaaatgtccccttggttggtaaaatgagacttgatggtaataatgttagaatgttcagcttttctatgtacaaataatttttgatttcctaaaagtggtaaaactatttcttacaggaaaacaagagtaatgagaaaatattagaacaactgaatgcattaagtgggtacacattctacaaaaccattctccttaatgatttgccagacttatttttaacaaaattttagaattacgtagaattaatataagtttaatatacatatttattattcaatagacactaaagaggtctccttttaataggcaagtgaatggttatttgtgaagctatttcaaattcattgtatagatgtctcagtgattttaatgatgactagggacatatttaatttaagacatactctaattttcaaaaataacctacactctatattcaattaggcataaagataatttttaaagttgcatggttactttctacctgaagtatacattgcagttttctacctaaaatataatacaacttttagtaatcttgttagctcaaagaaaaacattaatcaaatgttgagatcaaaaaaataaattcaaactgtaatataaactaatcaagtattttaccattaaattttgaggtacataaaaacaagtacaaaattaagtgtgataagctgtagtaaattcattacatatctttggaaatactttcccatattgtatagtaatttcaagtttgaaatgtgacaatcaaattttcagtaatctggggaagcatgattcttttgaaagcaaataaacaagtacaactattatttttatacctatagaaatatactattgatgggatttaaattcttctatatataccaaaacaggacttaaaaatcatgaacaaaagacaaatggtctttctttttctaatagaggcatgctaagttactggaattagccaatggagtgtatgtttaaacacaaacaagcaaacaaatgaataaaactgaaaaacaacatatcaatgagataacaagaagaaacccacaaatttaattgacatccagaaaaattgaagataaagagaaaaacataaaagcagaccaaaacaattaccttcacttggccgacatctgacggccaggagacagtaaaatatcttcaatctgctggaagaaataaatttgcctacctagaattctataattggtgacaatatttggaggaacaatggcattgacataaactaagagagctcactaccaggagacccacagtaaagggaattataaaggatgtgttttaggtagcaggaagttactccaggagaaggtatgtgttataagaaataataaagaacaaaaagctgaaataataccaaggtaatcaaagataaataatcactatgtgtgtgtatgaatataataatgaatactgattacttttacttctccttcataaatattagaaagtgagagcagtgagttaatttatagctcaaaattttgaattatatcatggaaaaatagccttcagaagtgttttacccttttccttcaagttgtttgtattttttgatgagcatgtacattttggataataaaatagaaattataaaactgattaagtacagagattattatcaccattaagaagaaatgagtggagttctaaaatttaatgagttactctgctaatgtgatttttatagtcatttttacaatttcagattagtttagtactgatgcacatcaaaatatgttgtaaatgaacaaggttaagtaatcaacatgcatgacttcaaattctttaatgtcattcaagtaaactgaagtaacttaataaaattcatcaaagggcttaatcagagtatacttttaataaacgacagacacaattcactttaagaaaacttcatgacctcccatataaatttaatttgttgagttacattatataataattattgattgtatatttgtgtgactagtatttaaaaacaagcttctgctagcaaagttaaatatttctaacaaatcatttgttttaaaatagtggagcctctagcctttagccagaggtgtgcatgaattccaaggaggagatttctttgcaaatttagtaaaaattgctcctttcttaaaagtgagtactcttatccatcatcaaacactggatttatatgattaacaaacatctaatgattgaattagaaatattaacatcagcatcactttctaaatatcaaacactggatgaaatttactaatgttactttattactatttatgaactatttgactgaatagtaaatgcttgcttacacatacaatttctttcttaagtttcatgattgattacaatatttcttaagataaattctatttagtgtttcacctccctattacatatagccaacacattaaacaactagactttttctccttaacactttttaaaagaattcaaacaattcattttttttgaaacatattgtgataattcataaatatcatggtttataatggttaaaaaatatcatagaaaaaagtattgcagagagcagaaatgattttgagctgattgggcatgataaatagaggcaaaagaccataggatatggcaaataaggagaggacaaaaatctattgaggaagaggtataagttgtgaagaaatcataaattaggtgagttacataccgcatactacaatgtaacttataagtgaagttgtttgtccattgtttggtaagtaacagattaaaaattgaattgatggcagcagatataaaatatcatatttaatccaaagaagagagggaagggagagaaagattatttaggagcctactacaataatccaacactgaggggtgtttgctagaataagtaaataaaatactgtaaataatatgcttgtagtaacaagaagaataaaagtgatgtgaaggctaaaagttgctgcaggctttctgaagaacaaatatattaagtgacaatttcaaatgggaagtgaaatggggaaaataaacggataactttatgtccttcaaatatgaaaaaagggaaagttgaggtgtcactaacagatgtgaatgacttaagaaaaaggactcattgttcagttattcatggtttcagcaggtatttcttggctatctcccgtgcacaaggaattatgctatataataggaatgaaaaactaaagaagagcagacatagttactgccacggtggaatttaaatttggtgagtgaaatgagcagtaaataacccacacagagaagagatataaaattacaattgcaaatatgcttataaaggagaggttcatgatgttagaaagcacattataggggagttttgactttgtcatgaagactgggaagagttttctgaagacatgaataccaagttcacttggatagaaatacagtagaaaaaagcagaaggctgtaaccaaaccttgagaaatgtccacagctggacacagtactaaaacgttttagtaaaaatgaccaggtggatatgttttgagactgaggaaaaaaatgaggaatacttgacaattttttactaaatgtgactaaaagtcactggccaaataaaaagtatacttaaattggaataagttgaatttgggccttaattattttcattaactatggtaccttggtaagcattcagatgacaaatgaactagctcgtgatacactttacctttgcagccttgcattataatacaaaattttgtacatataaattttacattttccaaatattgtatctagaatttcaaactacctgaatcacacaaataatgagattattcctgctataatttctgttataacacaatatgatctcttcctgacaagcattttatataaattactgcaattttaatgttaaatgttattttaacacttgtgtttggactccaacatggaattatattacttactttattagctcatttaccacctaccatgctatattattagataattctttgaacatgaaatgtttggggttacttctgatagtaatttaaggacccctttggcttaccatttactgtctctttccataactgtttcatgtctgtggtctttattaaaaattagggtaatttaatcagtactgattaagataactcttattcagagaagaatttgatgaattccaaagtgatattacaatgtaatttataaactctcttttgctaaaaagaaaatgttcaagccatcactttttagaaggattatttatattaataaatattttgaaagacttctacaattacattgaatattgtatggctttttctttatatgatacatttacaatatactaaacaatcaactcttctgctttcatcatatattatataggctttatgattctaggtatacatattatagtatgccctttaccagcaacagtggtagctgactcatgtcttccacattcactaaatttatatggcttgcatatatatatataatagttgaaattatatatatatttaaactttattaatatgtgagtttcggagtacctatagaaacttagactttcttcttgaaatatatttaacaatttagtggataaattataaaactaatatgtctttataaccaatatggtttccactatggagtagaaagcaatttatttctatcacctaggccaatttgataatttttaagagcattatttttattaaacacatggggatatatgactagtacaaattatataaacataacaccagcattgtcatatttcatatgaccaccttgagttatagctttgtatttgacttgactaatactttaatgcttttttgtgtgtgaccattaaatgatgcaagcgcattgtaattcatctaatgaaagtgtagacaaaagtaactaaagataaaaagtgcatgcattctattcattgaaggaaagacattactttttgtgtaatttaattaaaattcctctctctgtatatcactatataatgtagtttataaacagtttgcaatttgtacattaccaaactgagtgttttctcatttattgttattcatttctttttctctgcaccttattcatgctttcaaacatgctccctgagccttcttttccactcaccaataatactctgggttaaaatgtgaccttttagttattttcagttaaaagcattttctatcttgtttggtctcatttataacttcaattcagatcatgttgaaaattaatttccctttgcttttctcagtgttgaacaggagatgatgaccgattaatttaactcaccctttccttccttttctggatcttttctgttttgttgaatctagtgaagcagatatagtgaaagaagggaaaatatcttccctctaatatatcaagagaatcacatagagtcaaaaggcaaatgaaaactgtaagaaaatattgaaatttgtatgaaactgatgaataattattaaagtttagatgagaatagaaatacaaatcaggtagaaacatgagcaaaagacataaaaataagattccaagacaaaagtttacatatgtccttaagcattaaaaaaaattaagacttcactgaaatactacttttcatgtatcatacaagtaaaaattttaaaaatttgacactacactcaattggagaacctacagagaaaggcattatcacgagctgctgaacggcatttagcaatatctaataaaaatatatactgacgtttcctttgacccaaggatttcaccttaaaaaatgtactataaatacaacttttattcgtagaggtgtagagttgaataaatgaaaaaaatgcattaattgtgacattacatacaatagcaaaatgttggaaacaatccaaactcccatccacaggatacaagttgaatttattagggtcatttttgtaatggagtagtatgcaaatataaataagaatgaggaagatttctgtgaaccaataatcagagattcccagaatatatgtagagtagaagttcaatgggaagaatagaaatgcaagtaagacttttctaagcatatctttttatgttatttcttctgatttgaaaattagagcatgttaaatcaaagattcatatattcaaaaatacataataaactataaattaaaaactcagattttaaaatcaaatacaagaaaactctaatagtttatcaaattgctatcacaaaattatatgttaatgatatgggaggggtggcggagaagtgctgggtagagaaaggcaaggtccctggcgagggctccaccctcaggcctgtacccatggacctaagtgaggacaagcactcttgctttcgcacccaaatgttgcattttccaagaccactgtcgcccgccatgccccccactctgtgcctataaaaaccccgagaccctagcaggcacatacacaggcagctggacatccagaggagcagaggagcggtagagcacaccgacaggcaccggtagatgctggcaggccattgacggtgggaggcgtagaatttggccagaagcaatcaggggagagtccagccgctgggcagccagatttcagaggaagaccacctttctaacccatctctcttctggcctcccatccacctcaatgagagctacctccactcaataagatcttgcacccatcctccaaatcctatttttccagtacaccaggtaagaacctgggatacagaaagccctctgtgcttggcaataaggcagagggtctagttaagctgattaacacaagccacctgcagagggcaaaaaaagagtacactgttaacacatgcccactggggcttcgggagctgtaaacactcaactctagatgctgccacggagtcggagcccaaaaacgctccctccccatgacctgcccgtctgcatgctcccgctaggggtctgagcagaagggcacctaagaggcaggacacaccccatcacacgccctgcaaggatgatgagggaacttctcctgtttcattatgtagccttgaatactgttctttcattgtacattgttataaaggtatagctaaagccaaaataaactgtaaagaagatttaagtgttacttatcagattatctgaattctaaaatgctctatttgattataaacgttaggaggtattatatgttaaatacacacaaaataatgtggttaaattattcctaaatacttttaattattaaattatgcataaataatttctatattcagttttagattcagaaccttctgaattacttctcaactcagagatattgacaactttatttcacagattacaatgtcatccatctgtcttagtgattctggattgcttaagcaatgcaatgcttcactatcttttgtgctttttcctttcaatttatgacactcattctgcaaattttgatgtgggtccattttggatcttatcagaagttataaacaaaatatttttatgttttctcttcaagtggtcccctaaaatgtttgttgactgaaatgacaaggattattggttttacacttatgttataacgaatgataatcaagtcactctattttggcaaggttatttctttagttgttcagatacatgttcatgcagtacatcaaaagctaaagtacttgctgggttaaatagatgtctcagatacccagtcaagatgaattttaaccaacttcatttctctttcatattccctgagctctgagaaaaaaatattttcatatgaaggaaatatttcccctttcatgtttctttgagagttccgtatgctggtgaagtcccttctcttgagagatcagactttttatatactatgcacataactgaattgaagttacaataatataaacagctgtgaccaaatttgtgtgtaagtaatcatagctatgtgttaattgctgtctgacaaatgggatctgttaaagcatataagtaaatataaaagtatggattcaggcaagatttattaaaaaacaaaaaatgtaaaaaaatgccattttgaatttatgaaatatgtgagtcacttctcaacttttgttttaacaatctggaatacttcatatcattctaaaattttaaaaatcatttattgaattttatttattcattgatactttaaaagaatcccctctctatattattacagtctacaattattaccatatatactcttaaaaattacagtgtctttaagttttattagactattaaaattttcctttgtgggtgacctggtctttctctctggcggaccttaactttttttctttcatttagaccttggagaatctcatgattatgtgtcttgaggttgatcttctcatggagtatcttactggggttctctgcatttcctgaatttgaacgttggcctgtcttgctaggttggggaagttcctctggatgatatcctgaagtatgctttccatactggttgcattctccccaactctttcgggaacctcaatcagtcataaatttggtctctttacataacccatatttcttggaggttttgttcactcctgtttatttttttttaattcttgtatgcctgtcttatttcagaaagataatcttcaagctctgagattctttcctccatttcctctattcttctactgatgcttgtgattgcattgtgaaattcttgtgttgtgtttttcagctttatcagattggtgttcctctctaaactggctattctggctatcagctcctgtattgttttatcatggttcttagctcctttgcatgttcctttagctcagcaaagtttgttattacccatcttctgaagcccacttctgtcagttcagccattttagcctcagcaaagttctgtgccattgctggcgaagtgttgtgattatttggagaagaggcactcagaattttgaggttttagcatgtttgctaaacacttctcaaaaggagacatatatgtggctggaaaacatgaaaaagagtgcaacatcactgatcattagagaaatgtcaatcaaaaccacaatgagataacatctcacgccaggaatgacatttaataaaaagtgaaaaaacaacagatgctggtgaggttgtggagaaaaagaaatgcttttacactgttggtgggagtgtaaattagttcaaccattgtggaagacagtgtggcaattcctcaaagtcctatagggagaaataccatttgatccagcaatcccattactgagtatatacccaaaggattataaatcattctattataaggatacacgcatgcgtatgttcattgcagcactattcacagtagcaaagacaaggaatcaacacaaatgcccataaatgatagactggatcaagaaaatgtggtacatatataccatggaatactatgcagccataaatagcaatgaaatcatgttttttgcagggacatggatggagctggaaaccattatcctcagcaaactaatgcagaaacaaaaaaaaaaaaacaaactgaatgttcccccttataagtgggaactgaatgatgagaacacataggcacatggaggggaacaacacacactggagcctattgtgggggcatttggggagagagagcatcaggaagaatagctaatggatactgggcttaatacctaggtgacgggatctgtgcagcaaaacaccatggcacacgtttacctaatgtaacaaacttgcacatcctgtacatgtaccctggaaggtaaaataaaagttgaagaaaataaaagagaactaatgaaagcatctaaacattcctctgtttggagctactttctgggggtgagtggcagctataactagtgtaatgatctattaagtggaagtctgagtatttgaattcaccttgatggaacttgtgagaggcggtaatgtgtggcttcagagccaggtccatccggacatagagacaggctccccatcatgggctgtgtgactttgggacaagttacttaaactctgtaagcctctattgtcttcatctgtaaaatgaagataggaataaagttcacttgaaaacaaaacaaagcaaagcaaaaattttctgttgattcttgattcaattatggttatttttaatgcattggtttaatcaatacttcaatattatcataaacatacctactgttccaaaataataatttaaaatggaataaatattcaagcaagaaattttcttttttttttaagagggcacatttagttttatttattatatggaaacttttatgattttgagtctttaaaatggaattgtagaaaataattttaacttattctcgttcctttaaatttctgcaatatttaaatatggtcttgagcctccctgagatttttctcatgcaagttaatttggtcttttccatttgtggatttttttttattatactttacattctagggtacatgtgcacagcgtgcaggtttgttacatagagatacatgtgccatgctggtttgctgcacccatcaactcatcatttacattaggtatttaccctaatgctatccctcccccaacccccaccccaagacaggccctggtgtgtgatgtcccccaccctgtgtccatgtgttctcattgttcaactcctgcctatgagtgagaaaatgcagcgttgggttttctgtccttgtgatagtttgctgagaatgatggtttccagcttcatccatgtccctacaaaggatatgaactcatcatttttcatggctgcatagtattccatggtgtatatgggccacattttcttaatccagtctatcattgttggacatttggcttggttccaagtctttgctattgtgaatagtgccgcaataaacatacgtgtgcatgtgtctttatagtagcatgatttataatactttgggtatatacccagtaatgggatctctgcgttaaatggtatttctagttctagatccttgaagaatcgccacactgtcttccacaatggtttaaccaatttacactcccaccaacagtgtaaaagcattcctagtcctccacatcctctccggcatctgttgtttcctgatttttaatgattgccattctaactggcatgagatgatatctcattgtagttttgatttgaatttctctgatgaccagtgatgatgagcatttttgcatatgtctgtcagctgcttaaatgtcttcttttgagaagtgtctgttcatatcctttgtccagtttttgatggggttgtttgttttttccttacaaacttgtttaagttctttgtagattctggatattagccctttgtcagttgggtagattgcaaaatttttctcctattctgtaggttgccttttcactcttatgatagtttcttttgctgtgcagaagctctttggcttaattagatcccatttttctattttggcttttgttgccattgcttttggtgttttagtcatgaagtctttgtccatgcgtatgtcctgaatggtattgcctaggttttcttctagggtttttatggtgttaggtcttacgtttaagtctttagtccatcttgagttaatttttgtgtatgatgtaaggaagggatccagtttcagctttctacatgtggctagccagttttcccagcaccatttattaaatagggaatcctttcctcattcaagcaagaaattttcaaaagtgccataattggctgttttacattgataaaaattttatttcacagaatatacagtcattaacatttaagtacgacataatctaacaacttagaatacaatatttaaaaatgtttacaataaaatatataaaaataatgtcttcattaacaaattatttgttaggctggcatgatataaaaatattttattcaatcacagttcattacacttaactcacgaaaatgtaagcaagatattattagatttacgcaaagtggcagccctcttgtactacatattgtaaataattcaattataaataagatatgacctaagtctcaggtcagcttcaagtcgtattccacagatatacaactaagtgtaaagggagtaactctcctgatacctgactgttgctgtactgattggtccaattatatatacacacacacacacacacacacacaacatatataaaatatatatttacatataacatatataatttataatatatatttatatgtaacatatataaaattatatataatatatataaaattttatataaatatacatataaaatttgaccagtcagtacaacagtgaggtgtatatatacatatgtatatgtgtgtgtgtatatatatatatatatatatatatagtcaaattttatataagtttgttaaatgaataaatcattaatactctaaggtaggagcttgtgaaatatagcggttggaccaaatctggttcaccacttgtttctgtaaataaagttttattatagcacagcaatgttcattcatttacatactgtctatggctgcctgcagctaaaaatcacagttaagtagttaaaagagagaccacagggcctgcaacgatgagagtattaactttccagcccttaagagagttttccaaccccagttctatctggacacctccatgcagcttcatgaaagacctcaggcaagactggcagaaaacagattagtcaatttataaaataatgaggaatagtacattattatatgttaaaaatactaagtattggtggcgtttgttatacaataacagataactgaaacatttaatgaaagaaaaacaacaaggtaaagaattaattgtcctgtatattctgtttgactactggggacataaatatagatattgtagtaatgagttttagtttgcagaaaaaattaaattaatgatataatatgcattttaagagtgattgaaatgagttagtttttcttgaatattctctgtgcttgctgctatgcattcttgttttacatttagaaatataaaacgtaattgaaaatttttcttgcatgtttgctattattatattttaaatttctgccagttgaatggtatgtctaagatttatttcaaaataaccaaaggataagattgactagttgataattattgaattaggtggtgatgtatagtggtttatcatactattttctgtatttcatatgtgtttgaagattctgtaatgaaaaggtaaaacatttgtgttaatctattatttctaaattacgaagctcaattcttttagattttgttttatacactatagtatttaatatctaataaagaacatttaaaattacctagatcaggtcatatgaagtttgaacataataatgacattttggagtttaattctgacactcaagaacaatggtttcaaggggtcattttccaactaagtgtttcttaagtgaactctgaggaagaaaagaaacaatagtaaattatataaaatgatatagctaatttcaattttaaaagttgacagcatgtcctaaaacttctgaatcatccattcaaaactattacttatcctatgaagattaattatatctcaaatattttttatacttatgcttccataggagtatcttacatatgcaaataacctagaactaggaaattacctatactttttatgtaatttggagagaatgctccgtttcattcttggcaagcatgaacaagaagctaagttaaatccattgcttcatggtaattccatcaaagtgtatgctgtgtatattctctaaccctgtggaatgaacagaataacataaatatacatagtcttaaaacatttgagcaaagtgtagagggctggagaaaatgaaccatgtggatttctgggagaaggccattttatgcttaggaataaccaatgctaaggccatgaagcaagaggtcaggagcaaatcagaaagtttgacaatagtagaaaatattctgataattatcttaaagaacacatttttttttaatactaaacaaaggaaattcactttcacacttatagtttttgtcagtgggaaggttttgaaattgtatgaattctaactgactctagaggttagatagtattcatctcctttccccatagatgtctggctttctcaagtttgtctaaaatgtaatatacatattcaaaatgcagtagtcaatctctcttctggccactatgttcattgagagagaaattactaaaccaacattcccaagtttggagaaaaactacttttcttttctctctggagagagagcaggagactcaccacctcacaatatctactaccaatgcacaaggaagactcaagttgattttaaatgacatttagtattaatctatatgcattgtgtcatttattttttaaatgtatacatttggaaaagcaatgagtagccagtgttgattaaacaagtagtggctcaatataatatttcccattttaacattttaaaccttagtcccaaataacattaacttctgccaaaaaatctgcaacattaggaaaattcagaaaatagcaaatgcagagtctattccttctcattttccaagtcattgtctatgtcatggctttttcattttcagaataagtactttttttagaagattatacatttagcaattcgtagtgtattttgagttacattttgtaagatttttctcttgttcattttaaaaatggttagttgcataatggtttaaaacttataatctgaaaatttgttttacagtatttgagatacacttataaaaaatgtaatttcaactcttattttacagaagttgcaaagttccaaaggttatgaaaaaaataatgtaaatttgagactcccctcctttttccaaataaataaactttctataaaaatatgtacaatttttacagacatacatttacaagttttttgtcttaaaaattgaggacatttcatatttgtaactgtttatttagccttaagtcaagtattcttggccattactaggctaattaactaagaatcactgaaactacctcaaagtagaaaaggtataaaaatcctgaccactaggactattttttttttctatttttcaaaaagtgtacctgggaaagctaataatgagagaaaaagcttatcttcacactctgctgtatggtactgacacttttagtgatagttatattacttgtagccttaatcctttttacacaggtcactggcattgttagtgcttctcttttaacaccatagggaattaattattaggtcagcatatttaatgagttctgtaagtagcctcactattggccactctcctgttctcaagaaggaaattaagtctttccaccctaccatcttcactaaatctgaaaatcttcctccatggattctcaaacaacgtttgcttgttgaaactgaaatttgcctttttcagacagtgactcttcaatcaaaggggagtactttttccatgtatttgttcctatttgctataatcctcttgccacttgctttcctgtctaggttgctacaggaaaactcttggattttatagcctaggcaatttgaagtcaaacttcataaatacatttgatttcacagatagtatgtggttttggtagctgttgccagttaaaagtcaactattgcacttacaagcctatcttattaaatatgccaaaccagattctactctagcaacacctgcaaaagccagcaacacatttctgatgctgccttctaggtctacagagaagaaccccacagacccatcttagcctcaggtttgactagccagtcctgttttgtccttacaagaacatctgcattactttctgttaatggtttaatgcagctttcttggttaaatatatacttttttttctaccagataagtcaccaagttgttatatttttattcataaccttttagtcaatttgggcactaataattcttagcctgaagaaaattcttttaatatgtcttcctttaattctaagtcataaactacttttgtttatattgtatactctactcactcagctactatttaattctcaaagttgaaaaacttctaaatgtgggattccgtggtaagtgctactatgatatattcgagtaaatgcaatgcagagagaaatctataataacatatagaaacaccagaatataatttatatagatgaaaaaactatattgtggcttagactataaaaggtaagttgcacttgataaaaatgcatgtggaataggaacaattctaagttgattccccaaatctctgcactctggtgtacatgtactgcatcattcttaaggatacaaatgtgatggatttctctctcctggttaataattagtgatatggtttggctctgtgtccccacccaaatctcactttgaattgtaataacccccatgtgtcataggagggacctggtgggaggtaattgaataatggttttttttcctgtgctggtctcatgatagtgaataagttcatgagatctgatggttttataaagaggagttcccctgcatatgcttccttgactgcttccatgtaagatgtgtcttgcttccccttcaccttctcctgtgattgtaagccttcccagccatgtggatctgtgagtcaattaaacctcctccctttataaattacccagtctctgtcatgtctttattagcagcatgagaacagactaatacagtaaattggtaccaggagtgaggtgctgctgtaaagatacctgaaaatgtggaagcgactttggaactgggcaacaggcagaggttgcaatagtttggagagctaagaagaagataggaaaatgtgggaaagtttggaacttcctagagactcgttaaatggctttgacgaaaatgctgatagtgatatagacaataaattacaggctgaggtggtctcagaaaaatatgaggaaattgttggggactagagtgaagttcactcttgctatcctatgtaggggcattttgcccctgccctagagttctgtggaactttgaacatgagagagatgatttagggtatcagatgaaagaaatttctaagtgacaaagtgttcaagaggaagcaaagcataaaagtttgaaaaatttgcagcctcacgatgcagtagaaaagaaaatcccattttctgtggagaaattcaagcctgctgcagaaatttgcataagcaacaaggagaagaatgttaatcaccagtaaaatggggaaaatgtctgcagagcatgtcagagaccttgatggcagcccctctcattacagtcctggaggcctaagaggcaaaaatggatcagtgggtcaggtacagggtccccctgctgggtgcaacctagggacttggtgccctgtgtctcagctgctccagccatggctaagaggtgccaaggtacaggttgtgccgtggcttctgaaggtgcaagccccaagccttggaagcttccatgtggttttgggcctctgggggcacagaagaaaaaactgaggtttgggaacctctgcctagctttcagaggatgtatgctaatgcacagatgtccaggcagaagtgttctgcaggggtggggccctcatagagaacctctgctagggcagtgctaaaagaaaatgtggggttggagcccccacacagagtccccactggggcactgcctagtagggttgtgaaaagagggccaccatcctccagaccccacaatggtagatccactgacagcttgcacatgctcctgaaaagccacagacactcaacgccagctgtaaaagcagctaggagtggggaggtaccctgcaaaactacacgggtggagatgcccaaggtcatggaaacccacttctttcatcagcatgacctggatgtgagacatggagtcagaggagatcattttggagttttaagttttgactgccccactggatttcagacttgcgtggggcctgtagccccttggttttggccaatttctcccatttggaatgggaacatttatccaatgcctgtactaccatctaccgttgtatctagaaagtaaccaatttgcttttgattttataggctcatgggtggaagggacttgtcttgtttcagatgagactttggatcatggacttttgagttaatgctgaaatgagttaagactttgaaggactgttggggaggcatgattgcttttgaaatgtgaggacatgaggcttttggtggggggccaggggtaaaataatatggtttggctctgtgtccccaccaaatctcaccttgaattgtaataatttccgtgtgtcatgggagggtcccagtgggaggtaattgaatcatgggggcaatttttttgccatgctgttctcatgatagtgaataagtctcatgagatctgatggttttacaaaggggagatcccctgcacatgttcacttgcctactgccacataagatgtgtcttttttcctcttcaccttcttccatgcttgcaaggcctccctagtcatgtgaactgtgagtcaattaaacctctttcctttataaattactcaacctcgagtatgtcgttattagcagcatgagaacatactaatacaatcagtttatgcaatatggcacacacagctaattttaagacagggagattatcatggatgaacccgacctaattatgctagccactaactgcagagagtttagttagggtggttgcagagaaagaaatgtgagtgatacattccaggtagcctagaggaaagaaaacctccatctcacaaactcttcaaactcttcgtgggggctatgtgacaagaaatatgcagcctctagaactgagagtggccttttggctgacaaccagcaaggaaatgggaacctcagtgctaccactacaaggaactgaatccttccacaaccatgtaacttggaaaaggatcctgagctccaggtaagaactgcaactggatgataccttgagtttagccttgtgggttcctgaacagagaatctggtcaagtcatgtttggacttcttaccaaagaaccatgagataatagatggataaatttttaaaaatacgtaattattatttattattagtgtttactttttgcatgcaagttatatacaaatgcaacaatagaaaatgaatgcccatattgaacaatagaaaagtatattaaaaaagtttgaaagtcttcctttaatgatacttcaatgcctacttttctccatggagttaagcaatgttagtaaagtccatctattttataactttatatacacatttatatgcttacattttttaaaaaaagaaaaatgggatcaaactaagagtttttctataattgagctgttcacccaagtgttattgagacctttctatgtcagtatgtagagatctaccccattcattttaatggcagcacaacattctgtagaaagaaaacattttgtaatttatttaagcacacctcctttcttcctggctcccaccctactcccaaggttaaacccagtgtattgggttttactttgtatagagttttcttaatataaacacttgacaataaatatggttacaaagagatttgggacatacttaagaaaacttatttgggatggatttgaaggagtgcgggatcaaagcatatgcccattaaagattgtaacaaatactaccacgttgccttacaaaataattcatatgtttatacttccatcaacagtcagtgatgccttctcacacaacttcatcaacatttagagttcataatcttttaatttttgctaatcagattggtgaaaaatgttatttgattttaatttgaaaatctttgaaatttttactggtcctttagatgtatttatggttttgccttttacctttctgggtcatgtgtaatataaacgtgtaattttcacgagatcaaatcttttactctttttatatatggcatctgtgtgttgtttctctagttttaaaatgccatttgctatggcaacattagaaaataaaataaaagagaaagttgaggttattaagcacaatgaattctcactgaagtctagtggctttccaaaggcagggtgcgttttaaaaatttttatttttaattgtggttaaaaatagataatgtaaaatttaccatcttcatcattttaaaatgtatagttcaatatttgtattgtcatataacgactctccagaaattctgtcttggaaagttgaaactctacttattaaacaataaatcatcatttcctcccctcccctaatcctctgtcaaccaccattctacttcctgtttctgtgaatttgactacgctagctacttaatataaatggaatcagagagtatttgtttttgtgactggcttgtttcacttaacataatctcttcaagtattattctgtagcatgtgtcagaatgtccttctcttttaaggctgaataatagtccattgcataagtataacaattttttttattcattcatctgtttatgaacatttgtgtttcttctacctcttagctatcataaataggactagtgtgaacatgagtgtagggagaatattttaagccactgaacttgtagtattctattacacagcactggaaaactaataaacttggttttactttttttaatggcttcattaacacaactaaatttattaatcaagatgtacaacaaaaagtgtgtaaagtaacaaatgcatgtggtaaaatcttactagatattataactaaggaatggaactacatgatagctaacataataaagtatttttaagagtacttggaaaaatattttactgtggaagagtaataaacgtgctctaaaacaacgtaaatgactatagggatacaattacattttgaaaatcacactaagatcaaaacgaaataaaactctatagctactcactagtcatcagaataggagagagaaatgcaatatgaaattaactggtcgaaatgattcatagtctatatcaccatgtctattttctgtttgaaataatcatgttaggctgggcgcagtggctcacgcctctaatcccagcgctttgggaggcccaggcaggcagatcacgaggtcaggagatcgagatcatcctggctaacacagtgagaccccgtctctactaaaaatgcaaaaaaaaaaaaattagccgggtgtggtggcgggtgcctgtagtcccagatactcgggaggctgaggcaggagaatggcgtgaacccaggaggcggagcttgcagtgagccgagatcacaccactgcactccagcctgggcaacagagcgagactctgtcaaaaaaaaatcatgttataattttcacttgaattatacttcttatatttttgtttaaataattaagctaaggcacataattaatattttagtgtgctatatgggttcttcaacttgagccttccacctagagaactgtgaaacaggtatgacacatgaaacccaacatcttggtattttcatttaaaataacatattggaatattactaacttgaacatttgaattataactttttcacacataaaaataggaatttctagttttatgatcattttaaaccacactaaaatagtctataatatttagggcatgtaagtgctcttccatgaatttatggctatttgctctcatttaccactcagctttaggaccctaagggttctatattctgtttcctacataaattttccttcatgacctgcctcttttcttttctttcttacttgattccgctgcctgcaaagaaaaaaaaaattgcaatttgaaaaaaggcactttaaacactaaaaatgattgaacttttctctgttttgtctatgtaccctgtgtattgtcaaccacccaatcaactactcagttttaatatctaattgcctgtcttagcacatacttaagtcttcatttacatccttgctttagtataaacactgtttcacaacctctattatttatgccagaagaaatttggtccatctatcaaagacaaaaaagacaaaatgttatttctgattcggaactgatagttatagcttctctttcctctgggatgccataacaatctgtatttttcaaaaattcaatcctttatcctataaacatggcagggatcttgaataaatatagagtacagggaataaacctaagtatagaaataaatgggttaatgaaaagaaaaacgtggaggaaaaaaattgtctatttgatacagacttccttttgttttttccatcttttcatgtaatgaaatgtgagtgcatattgtgaaggaaacaaccaatatatatagcaaatatcaagacgtaagctatatacacatttattttgaaaatgaattaactggttaattctgaatgcaattttttggtgatttgtttaagaaaacaaaatagtaaatgtaatataagctactaagattaatcagcatgtgtttgcttcaagtagtcatagctccttctgaaatgtcttttaaatgtcaatatcagttaaacagactttgtaggaatctggttgctggggagaatttatgaaaatttttgctatcctgtttcttgaagaatcttatcatgtgtcttctctctggtggaaataaactgggagtcctttccttaatatggcgtattttcaaaggttcaaaagcataagtgtagtagtctacattctgtcacactgaaatcatggatgtcactaagttatcccaattttcatatctaacttttctctgaaaaacttttatttttaaaaatttctttctaaaactatgttatttataaaatattatatggctaccctcttacttatataatgtatacatgtatttattcatctaatatgtatttattgaactcttcctgtaatacagagattgttcaaagccctggtgagatcatggtggacaaggaaggtcctgtcatcaagaaacacacatctattggagagttagccaacaaatacatgaataatacaatgtgaagtagtggtagctttacaaaaacaaaacagggaaaggcaaggagatatgaaatcttgaggatgcaatgagaaggaatcttttaaataaggtggccagaagtggttaacatgaaggaatgaatttgagccaaggcctaaatgaattaaaaaggtagccactggggaatgctgtggagggaggacacagttatcacgtggccagtgttctaatcagaataactaaggcagagtaccatagaccaggtgagagatacaggtaagggagacgtgtcacatctggatacaaaacagtatttgatgttttttctttttcgtagatattttggacagttttgaacaggaaagatgttaatctcattagcgtctttgaaagatcactctacttacaatatggagaactaactgtgggagagtagaaatggaaacagagaaatctgtcaggaggttttgcaatattttagctaaaatgttggtagtttaaactgcagtagcagcaatagattatctcaccgaggatatatgttaaatgagtcagcaagccttgctgattgattgggtgcaagaaatagaatttatagatgacaaatagattttcgccagaacaaccaactgaattatttattagatggtggagagagaaaagagtatgttcaggtttaggaggaaatcaggagacttgtttcaggcataatcagtttgagatgcttattaggtatccaaatgcagatgtcaaataggtattttgatgtaagagtatggtggttatgggagaaatcacagttggagatatttaatgtagacagggcttaaagatacggggctagatgagagcattttgagtgaggatggcacagagaagcaattaaattatttgatagttctgtgtacttattataattatgtaaaatttatataaaaataaaagataaaacagaaaaatatcaccaaatagttggactgtgcagaggttaggtttattttccaaagtttatgtaatgtggttatgttaaatttattatttacaaatgcatattttggtaatctttcaagcttgttataagcccaacattttctttgttttttttttttcacattttagggagaaataaagtgtgttacagaaaaaatgaatgaatctggaatagataatttagcgctaaggttcctgacattgtccttatctaaatattatttgtcaatcccagatcagtgttttctaggggcatgcttaattgttctaaaattttaaacaagagcattaatatatttggtaacaatcattctattcaattaacgattacactgggttgaattttttcatgagaaaagctgcaaactacttttcccaaattctcctctattgtatctttcttagagttgatcagaaaagaatttgtgtgaggtttgaagagagggtcttgaaggtttttatgaccagatacactgacagggaagtgtagaactgttgttcagtatatttcaccttgacctcactcttctgtctgcatcctgctttcttcttaaatgctggacctcctgaccatcaacagcctcatctccaccatgagatgcttggctagggacccacaatgctagtgactccatagtccattattttaatcgacctcaccatgatatcccattttcccctccccacatttgtcacttgatatacttggcttaggcttgtcaccttgcttcagagagctcctttgacactccagatctcccaaagctttactcttctacctcctcccataattgttccttataataaattccttaattcataatgctcatagtgtctctgtttccctgactgagcactgactgacgcagaagctatcattcactgtgctgcttttactactcaactttcccctttggttcatgttaaaatttaaattttaagcaattattctcattctcaaattgtgacgagaaacaaaataaaatctaatagtataattttatattttggtgatacgtgttttttcttttaactactatttttcataacattaaataagctgaaaaatacatcaatagttgaaaaataaatcagaattgataaatgttaaaattcatttagaacaaaagtaaaatttttccaagagtaaagttaaataaaatacatgtgatatggtttggctctatgtccccacttaaatctcatctcaaattgtatttcccacgttgagggagggagatgattgaatcacggggggcagtttccttcatgctgttcttgtgatagtgagtgagttctcacgagatcgtctggttttataagcatctggcatttcctctgcttgcactcactccccccaccacccaccgctttgcaaagtagatgcctgcttcccctttgccttctgccatgatgtaaatctcctgagtcctccctagccatgaagaactgtaagtcaatgaaacctctttcctttgtaaattacccagtgttggttatttctttatagcagtgtgaaaatgaactaattcaatatgatattaaatagtacttgttcgacatgccatatataccattatttatattgttgggtgtgcatgtcactgtggactcatgtatgtgtttgaaaatgtagtctgttgtaaatttgatccaaccaagatctttagtagccatcttttaggatataatatggtcagtaaaaggtttctggaaccatgctaatacaaactcacaatttaaaattattcatttaataatggcaacaattttctcataagcacaaaaatttcataatataaaaagcttcaagttcatattgtttattttttccaaatgctttttgaaattaaataaaattaccatttaatataaactaactctaataaagattaaacttacatactgttgtaaaagtaaaaaaatgggttgagtttctataatatcaagagaatgcacagtgatgatttatctctttcagggttaatattttcacatagcaaaatattatatttgactagaagactgctagctgaagttttactatcaacagttcttacctatttttctttatttttcttcatgttttcttaaattaaaaacagaattaggaaaatcccatcacaaatttacattgtagaaatgtcagcttcacctcattatataaatacctatagattatgtttctaaattgtcttataatatactatgcatattatccacatttttaaaactgtaaaatataatgatggataataacatcatttttattacttatacctacatatatttaagaataaacatatacattctgaataatttcaatgtccctaatagacctgcaagcagtgttgagagtgatcactccataattcacaagagatccaataggttgtttcagtcattttactttcagtcattttgctttccaaatgtcacttaaaattttcaaaggaaaaccaaaaaattaaatgtaaaatggatacaaatagatctatatttcattatatgtttaaaaatgtactctgccatagtcatgttttccttctgagagtagggaactcctcactcttatttagtcaacattaaacaatttgagcttttctaaatgaaacggataggggaacctatgatttccagtatacggtttttactggatgatactgtgtaatgttatgccacatattcagactttaatttaattagatacgtttataagaaaatgtcattttcatagaacagggagaactggaagttgacaccttaagtatcccgtgacataagaaattcaaacttgtttgtagcagacttaaatatgctctaattcatatatttgggtatgtaacctgatcatataagcaatattctaggcatcacattttaattctcatgcagtaataatatacaaaaacttttagtaagatactaaaaatttaatattcatgcaatagtaatatactagtaatatactagaaatgatgaaaattcttttttaaaaatattgaaagacatgtatttttcctctactatcttgaagtaactggattttgttttcatcaatatatttcttcttgaatgaactaaggtaatgtatttccattctattttttgaatttaactacttagcttctgttagtattcaacccaaggtagtgttgaggcaattaatagtaaactatttttgaaattcaaaaattatcaagtagtatagtaaactaattcatttaaaaataaatttttagtagatatgttgttttatgttaaggctgttgaagaataattttaaattaaaaggtaaaacaacacattgttgaaattctggtcaagggacaatgtaaaataattaccataatgtaagatgcacattttttgagagagcatgtaattatgttttcaatttttcccttgtggttttcattgctatatcatatatggtgatattttaacattatctgatagtcacaaaattcagacagagctgaggttgcatttctgagacatcacaaataaaatgtaatataagtgaagaggtaatctattgtgaaaaatctgaaaaaagaaaacagctctaattataatacaaagactgaaacgtttgccaaaattggaaatgatactgtgccttagtcatcttaggctgccataacaaaataccatagactcagtggcttaaacaacagaaatttatcatatcacggttctggaggttggaagtctgagattaagttgcaataacggttgggttgttgtgagagctgacttccttgcttgcatgctgccaccttctcactgtgtcctcacatagcagagacagagactgcaaactctaccatctcttttcataagaggactaatcttgtcatgagtacccctccctcatgactccatataaatctaattatctcccacagattccatctccaaacaccattacattgggggttaaggtttcaacatacgaattttgggtagacataattcagtctatagcagaagtgaatgcttttgaaaatgtaatggttaaaagcaaacatgaagagttgtatgcctggtttggcaaggcatatagtaaactcgtatcttaaacttcacctactcatatcttacataaaaacaatatctcaaatcgctgtgagatataggttactgatgatttatttaatgcaattttaccctgagtggataaataatatttacataaaaaagcatcaatcactcaagtattcttttgcgattgattgattcttttgtgatcatatgtaatctcaaaattgcaaatacctcataacacggaatcaatttaaatttctgccaggccccatttctacaaaaaagaaaaatattagccaggcgtggtgccatacacctatagtcccagctatttaggaagctaaggtgggaggatcatttgtgcccaggagttcaagactgcagtaagctatgatcatgccactgaactccaggctgggttacagagtgagacactgtctctaaacaaattaatacattaatttgtttaatttttaactatcattaatatctattcaaaaatattgttcaaattttctttagcatattctgcttgatgtattcagagaatgacccttcacaaggcaattgtcaaaatcctaattgattgttattataattatttttaagctaaggcagttaggcaatgttgtcaattgctcaatgttaatatgttgaccgcaaaagcacctataaagtgaatgagtattgcatgcagattagtttaatatctcagtgtctgaagagaaagacagtcgcttagtttctcaagtggaatgggtacttttagattttccagttaaaaaagtttactttaagacttcaggctgcctggttccttgacctttgtgtttctactttctaaaattgtagttatcagattttttatttttttggttctagtcttagttgtgaaaagaatctgaatttgaggtaagaggaccttaagaaggcttggttacatattttgtctgctttgtagaaaatggccctgtctgctacttgtacactcagacttaatcactaagaacatgatcttcatctggaagcacattacacatagcaaatcttgatagctctactagatctgtgatttatagcacgctgtttaaccttgctcttagtttctttatatgtgaaacaggggtaataattgaacatgccatactgagttgttacaaagattagtttgatatttaaaacatctctgtacccaaaaacaaattgcaggaaatggtgggcagaggatcatgttgaacggcattataatcattataatacctggaccacagtaaaaattatgtatttcttattaactagagttttgccttagtcatattcttacattccatgttgagtcagcttggtacctcagaacatttgaggaacgcctttcacttgacctgagcaagcctaataaaactattgcaaaataatctaaagcactttgattaagtaataaaagacatgaaaacacaaaaataagaatgtgaaaaactcagaaataagatggcagaaccaagaaagaattataagtgaaagataaatactggaaattgaagctaaagaattataaaagtaaacagatacaatacatacagctctaagataaatagaagacaacaaaaataaatttgaaataattgaaacaaagagataaggatctgagaaaaaggacatattgaagacagaaaaagaagagcctttatataattactaagagtcttgaaatttaaaaaaaaatgaaaaaataaattctaaacaataattttcaagaatataagaaaaaaaagaaactaggaactctaagagcacaccatgtgtctgagagtattaagccagaataaccatcatcaaatataccctaggacaactactgaactttaaaaataaacagaaacataattctctctttaggcatccaggcaaccaaggcacataccttatagagaatgaaagaaaattggtaactattagacttttagatagtactactttaagtcacaggaaattggactgctcaacaaaatacaatgtaagccaagaattttacatccagcaatctagtgtaaaggacacagaaaacagttattgacatgttttctcaggaaaacattttccaggagtccttcttgaagtatctctgaaagaatgagttccattcaaccaaaatactcgagtgagatcaataaaaataactgatagtattaagtatatagttattagtagaacaagataaaagttaaaaggaagagaatgcagagatggttacattctttgacaatgtaaatatagtaccaccattaatgaatgaatgggtgagaatgggaatagaatatacacagaactctttctgtgtttagtaattataattgattgtggtagtgtaagtattgtgatcctgaaactgatgtgtgtgtactgtgggttaaagcaaatgagtgattagaagatattctaattctttcattccttgtattcatgagaatgggggttcttatggaagaaagagacaaaatgtaacataagattatgtttaaaatatgatagatttgaatttgaattagaaaagtcagtgtgaatttatatggtaatttatcattaaaaatgtgtagtgtatattttctagttctgcccactggaaagccctagaaacaatatacaacgtagcagcaatgaaattgctaagcctaaattgtgatcttgagatgaacatttctcactaaaagaaatgaagctttcctgtggaaatagcaatttcaggtctgaggtaagaaatatgcaaaattagcgtggaatttcttatcacattggaaaggaagaaagctaataattattaccagaatcaagtcaaaaggactcagcaacctactttaagaatctcccagtcgccagtgatgggggaattttatcttcaatggggtttagaattataatggcttgaaacccatcaaatgtgtttaaatctgtgaatgcataatcacatgaaaaaaaaaaactagtcaacttgggaggttggtgatcaatatgttgatactttttttaaatagagaatcaagcaggtatattggtcttcatatattaactgtactatttagtaaacagagtgagaaaaaacatcttgttataagtgtattccagctaatcaataataataaaagatagactattaccattttgcagcccccaatgagttaatgggtctatgcattgaacatcaactgttgctagcatttgcctcttgatagaaaaactcagttctaccaatcctcctgccaaaggcatcaaatcggtcaattcaagactctgaatcataataaggcaaacaacaacaacaacaaacaaaaaaccaacacttgagagcatcaacaggttagacagcactcaattcttcaaaatataagttgagaggaaacacaaattaaaagagagagacataaaagccatgacttttaaataagccagatcatatcatattgttcaatgttacacatttgcataataaaaccataaagggacacatgagaagtatgtatgcaaaaatcaggataatgattgcttttgcaacaaaaaagagaaggatgatagaaaagggaaagtgtccggcaaagttctatttcttgactcaagtggtgattaaaatggtgttcatcatataataatttactaagttatttatacatatggataaaagacattaaaaatgaaataagtcttaaataaggcatgtggagaaatacctattcattaggtgatagacaaaagaaaggataaaagaaaagacactttgtcaaacatgatttcagagtaaattcttctaaatgtacattttaatatttttctttctatataattatgccatagaaaacctttatagttcaattgaaacagaatctgcttttaaaatatatatgtatatatatttgttattacaaatatatataaactttacttgtttttacaaatatatatatttgtaaatacatataaatatttgtaaaatatataaatattttacatattttatattttataaaaatatttatattttacaaatatatatttgtagaaacaagtaaagtagattgcagtttgcaaacactggaagaaaataacaaaatttcagctaatttaacttactactacaaaatcacacacacacacacacacacaaacacacacacacaaaggacatttgagctatgataatagtaatgcattgtatgctttttattacttttagaaaaattaaaaaataatgtaactgactatgaaaaggttagcaatgtattttttgtatactagaaaattgtctactagaaatgtgaaggacaagaaagtttatttttaaattataggggctgatatagtagttcccctttatatacagtttccctttcagtggtttcagtaacctacagtacatacaataaagcatttgaaggaaaaatagagagatcatattcccataacttttagacagtatattgtcataattgctttattttattatgagtttttgttgctaacctctcactgtgcctaatgtatagattaaattttatcataggtataaatgtataggaaaatacgtagtatatatagggtcctgtactatccagttgcaggcatccactggtgttcttggaacatatccccccgtggaaaaagagggattaaagtaaattggtatggttccataaaactattaggaagcaatatcatagtggagaagcaatatcatagcaatatcatatgactttttatgtgaatgttcctgcaattaataaattgcagttagacatgtgaagagcaagattttcatactgagcaaaatatttacacacaagcttaaattaaatggcattgatttggaaaataaatggaaagagtatagcattcagagtctgatgaagattactgtctaccccccaaaaattgcactctgccttctatcatgtggggttacttcttgaggtggctgcccagtcacaacttttctatatccctccccacaatggaaccaggtgtagccatgtaattcatttcattaatggaaatgaattaattttaaaggtggttaaaagaatcatagctcactttctagtaagaagttttaaaaagtacatccaacttgtccatttgtcttttttattctatcactgaatggagagaattctaaggccctaagagggtatcaggcagagtcatacaacaaaaagagtcaggtttctgaatcacaaagtgcacaaaagctacctcccaataggaaatctgtataagattttcaatgaaagagagataaaattacattatatcaccagtgaaaatctatataagattttaaatgaaagagaaatgaaattacattgtatcaaaccactgattttgttaatgacaagaactagggttatccttattcatacaaagtctgacagatctcagtaaacaattggttaatatatttggacatttacttaacatttctaaaaagcatattttcatttattcaatgaaatactttgtaaactacttttacaaaccaccttcttggtaaaatagtatgaaaattagagatacacattaagcatcattacatttcttggtatttcagaggtcctccgtaaatgacaagattattaacattaacattattttataatgcaaatcaactttcccatttctacctttttttattttggggcaaactttttatcaaatacaatttttatattataagattttacaaagaagtagtacttttgtaagagaagacattgggtttagccatgtgcatgcttcacctactttaagaaatagcaaattaaaagacatggctttatattgttctttcatatctcttaaagtgcctaacacaaagcctgacacatattagccatggaaacataagaggaggtttacattagggatagtttcatgaaagtcatcacctaacacagccatgaaaaaatattgagttaaagttccccataatactattaatatttgcaaaacctcttgtaccttctgtcactatgaatcccaaatgacttaatttacaagtaattattctgaagaagttttctgctgttatgttattttatgaacaatttccaattatttttttttactcagctagaaaaaaagataaaattcaaattaagaatacagcattttcatctctgaatagaaccattttgaccttgtttgacatagacatctttctattgtaaatctataacagtttggtaccacagatctccctagacattgctaatcctcagagcactttatcaccaatgtatacatgtataatagagaatttaagaagtcatatgctcctacatttgcatttttttcctctgataaacaatcactttacttcaaaggtgattgtccttcacttcttaccaaaaaagctcattgtataacagagattccctgactttacaattccagagctcatttattaatgtgatgagtcatattaggtataaattgaggagattaacagataagataaggagaaaggaaagagatcattatgttactagactttaaaaagtatcatatacctctagtgctgtgagacattttgtagttcttataagggtttttaaaatgaactctcttgaaaggaaattattcaaagcctttgaacaatgttagcatgatttaaagtacacttttgaaaaatctttgatttatcggtaaaatatttagaacattataatgtattatattatttcaattatattttgtatacaaccctgaaatctttaaatgactgatattaatttgggttcaaaaagctttgagagttgagttgcaatgtttccatttttaattgttcagtaaaataaacatggaaccagaaaaataaataagcatattaacaaaaataggggaggcccatcacaagaatctgttggaaatgaccagaatttaaagcccactgatgagggattgaaatgtagtgtcagaacatacttatgttttaactttcaaatgcaaagcataattatgtaagaaaatagcaatgggtttactggaggcaacctggctattatccatataagacgtggagtatattctcctcactagtgaggctacaggggagtctctgggaacctcaatgatatttgttgtcaaaaggctgagatggatgattgtagatgctccatgggatagggctgcctagtttcattttggatattagtaatcaggaattgtacaggccagcaggcaatgcctttaattcagaggcagcaaggccagagaacaaagcatgctgccctaaccttcagggatctctagaaatgacattgttctatgggaaaatatacatagtaagatgactgtagtatttattggctgtaaaagaatactgattattaataatgacaagagaaatgtgcaataagatcacatcaaactgaagttgaaaatctaattcattctattagtttctggtattaaattaatcgtaggataagagaccaatagaattttgatagagaaggcagcataatcataaatttttaaagaaatattttttgaagtgtgagacattagaacatcattggataataaataagattaatctgagagatggataaattgactatgcagagaagggaggctacaattttagaaagtagtttctgataagatgagacggacattagaattcagaaaatggcatatttgaaccaagaggaattggttgttaggaaccactggatgcctgccaaaggtgaagaagccactctataaatgaggcaaagtcttactttcatatggtgagataattgagttatttttatatgcaatgatttttacctaactgcatcatgtaggtactttttgtacttaaatttaggattataattggtactaactgaaattcctgtggaaataaataaagcagaaagatgcatgcactgaaggaagagatagaggcagcacaattttggaaggaaaataaaatattgcttataggtatttctttgaaagtgttggaagtgaattattcaagccagagttcattcaatcttcaggtcaccatctctgccagcattctagagaagctaatggtaagcatggctattaaatgtaaaactcaaataagataaaatttggaaattccaccaaaaaagcatactgagcttgatacagagaattagaagtttaaggaagaactttgagagctccagagccacacactaaactttttaaagaaaaattttcaataatatagggtaaataatcataattaaataaaaatattttttgcagtgttagttataactcttaagacatactagattatggttagcagatcctttaaggtatataaagaattatttccacgatttaatagtttattacctaatcttcaaaggttattagaaacaataactatgaaaggagtaattttttcaagaagttttgaggcaaattaattgctttcccatatacaaaattctgttttgaaaatttaatgcaaaagtcttgttccagagcataaaaagaacattttagcaagttaatagtaagacaacacaattctcaaaactgggccaaagatttgaacagacatttcaccaatgtgtgaatgcctaattagggaaacacaaactgaaaccacaatgagatgctagtgtttaaacaatcatcatcatcatcatcatccaaagatattcaatattaagcactggcaagaatatagagaaactgaaaccttcatacattgctgctgaggatgtcaaattattttgccaccttgaaaatcatcttgtttgtttcctaagatgtgaaaaataaatttagcatataatacagcagttccattcatgagtatctacctgatgaaatgaaaataagtctacacaaatacttgcaaataaatattcttagtactattattcatagtagcaccaaactggaaagaataaaaatttctatcaatttgtgaattgataaacagtgtgccatccatacaagggaacactgtttggcagtagaaaagaataaattactaattcatgctacatggatgaagctcaagtagccaggtatgatatgctttatattatatgattgtatgtttttaaaatgaccagaaaaggcaaatctattgagtcagaactcagatcagtggctgcctagggctggggttgggagcagagattatctgcaaattagcaaaaaataaaatgtaaaataaaataaaattagtctaaattctttaaagaattatggaaatattttaaaactgagttgcaatgatggttgcacaattatgaatttattaaaattgttaaaatgtatacttataatagatgatgaaatttattataagtaaattagagctcaataaacctttaaaatcaacaaacagtaaggggtagggaatgctgaaagctaatatggaaaattaagttctacaatcattttgtaaactgcaatataaaagacagaactcatgttaaaatcaatctataaaactatattatgtaaacacagaatatagaacaaatcttttttatacctaggattgagatttatattttggaatttttgaaaattcttccctaacctgccattttccctcaatcaaaatatgtatgacacaaatggttgcaagttataaaggaccaaattattttcaccttttttgagataaggcaaacaaacaaaatatgatccctaacctcaatataaacatacctaacaacttttacatctgaattttagtcatttatttatttatttataaaaaaagagatcttgattttacagatatttgtgtgaacttcccattgaggggttttaaaaaagacattattaaatagggcatggatcctaactaaaagagggagttcaacttcatatgccttaaaaactgcctagattaaagagtatttcaagctaattttcatataaatttgctatatgatgtatatgaccttagcattgagtttggaagaaaacacaacagtgctacaaaatctcttaggtagaaatttcctacatagtgacagggtttgcttggaaatcatctgtaccaagactatatatatatatatatgtataaaattaaattttgtatacatatatatagatagatgcaagactagatgggatctcaaaacatgaaaaatagactctctgtttcccttgataatgataaaatcatctattatagatgaatatttcttaaacctgacaaatggctgttaaattgggaaaggattaccagtgattctttagggtgaagagaaattaactacatatatacacttttgaaaattttatcttaatgcaataaatttcacattccttacttaatattggaaaaggagaagtaaacttatctctacttgtagataacattatcttgttcatagaaaatcctaaggaatctataagaaaaagctattagaagtaataaacaagtaagtaataccatataagatttatataaaaatatcaattgtattgttgtacactagcattggacattctgaaaataaagtttcttttaaatttcatttgtaatagtattaagcaaaataaaatttcatttttaatagtattaagcaaaatatttaaaatataacaaaaatacaagaattacagactaaaaaacaataaaaatattttttaaagaaattatgttgataaaaaacttaaataaatggaagaattgtgttcatgaattgggtaacttttaaacaaacttcctggtttgtagtgtatatatttgtatctactttagctaaacttgggaagaaaagaaataatgggatgctgagtatgagaacctattggacctatttttaagagatttcagtcccaatattatttattatctactgttatctgtgggttgatgatgccatcacaggtcttctatggttagggtcagctcaggttccatattcaacagtcctggaaaggtctgagtactctctgtccaatatgcagttacttaggtaaatgcctagaagtcattcagaggaaggcatcgggactcatgtctgttgtgctcacctgtggtaggattggaggggcttccacaagaaaattacgttctttttcaatctatgtgctctcagtttgaaaactgattttattccaggaactgagttacaattttctattatggtgtttatatcaaccttctgctcacaagctgttgatgttttttggctacacaagtcaatcaacagcctaatctgctgtctgtctcacctctagtaaaacaagcatctcagcagatctctctgagtcaaagcacctacctgattgccgctattgctgaacattgtatcatttacattcaccttttttttgacagttaatcgctcccacttggcctctgctgttctggaaacttatctgtctcattgatattagaaagcccagtttcttggcagcttctcctaaaataaaccaacaaccaccacagaacttaatcaagaatgcagtacactctttactgccataatgcacaagtcagcaaactttctgtaaagagacacttagtaaatattttagggtttctaggccatggacagtcaagtattttcctttgctcgcttttacaaccctttaaaaactcaaaaattatttttagctcacagacacacaaaaacaggtcactctgtagatttggctcctggacatagtctgtgacctctgccttaatgagatgagtgtgtccttgagagaatacaccaggggatggattttctggtcaacattcaaaccacctatagccttctgatttcttcctcaatactctgccaagtaagttctagcattccacttcatttacacaggcattattgattgcaagttttaagaagccatcacagcaatatattagtattagattctaaatgatgatagatccatgcaaataaactctccttatgttaacgctacaccctgtgtccaacaccattaaggtagaccctcacctgtgactgcctggtttctgctgatatatattacccaagtctttcaatcattttatttcataagcaagataattccttgggtcagtgatagtatttattttcttaggctaaattgacccttctattgatctgtcacaaacaaacgggggcagactatggaagagttattagtcaatagttcactaaggtgaaactaatgtcctccaggaaagagacctgtggcctaagcattgagggtaatttgagttttcaaggttatcagcacatccagccaaatattttcatcctgtatctcagtggactactcctccctttagtaccctgatgtttgcataggagaatgtacattcaatttcctttgtgggtccaccccatttacaattaaatccttggcctgattttctgcacagtctgccctccagaatcagaagacagtgatttctttaaatgcttccatggagtttttgtgacatttacagcattctctgatttaatagttggatgacctgagtctatactttccttactttaagacttccaagttatttaacaaaaagccagctatcttcataatctttacaattttaattattaaaataatttctaggactactgagaaggccagtgcttttgctttaacttgtatttcacatcaggtcatttcagattattgttttaattagtgtgatgatgtaacctgctggggattattgttactacacttagaactaacaatggagtctttcttacttttggggtacagaagtgatccttcaataataccatcctgaggttctgcttcctagggccacttccagtacctagtgttttaatgtagattctcaaaaatcaaagctaaagacatagatttagatgatgttgaattttctaagaaatggagatgagaaactggggaaaacagataagatattgaagaaagaaaagtcagtataagggaggcactgttgagattactgcatttggcaacaggggctcagttccaccagactgtgttaaggaacataaaggatgttgccaagaattgtctatctgatgcatggaagatgagggtatccctccacccactcttgtttcttaatggtggctggatcccctatgggtcatcaatatctcagttgtatgaacactgaataggtcccagtagtttagagaagctcctgaaacagaaaatggaaatatgtgttgtgcaggtgtgtgagaaggcacagaaagcaggaatctgagcttgcatggaactgaacactgcaactgaggctgacttaggaggaagactgagaggaaatgaggtaaagtactaaaaggcccacactgaaaccctatcattgatagaactagaaagctagtgaatggataaagactaaattaaagactgtactctctcagcactggtcatttttcctgcagtgatccaaggttcagcaatggcagctagcttttctatgttttttggtgaaagaattaagtcatatttgttcattttttctactccttaattaatttaggctcaacatcaaattttttagtgcttgttaatgacataaagattggtgaggattcagaaatgaattttcaggttttttgttttaaattttaatatatatatatttctttaaatttaagtatataaatttaaataaaatattttcaataaattagaatttaaaatatatattttaaatctaatatctatgactaatatatttatatatttagaatttatatatctatatgtaaagatattaaaataataaaatatattaaatgatatatacatatcatttaatatctttatagataaatatataaaaatcctaacatatataaatatttatattagagttctatatattagaaaaagtatataatatatatattttttccagtttgagggatatttttatatatatatcctttgaggtacattttatgacatagtctcatgcaagaacatcaaaaatacataactaaaatttccctagaggttttgaacattttaagaaaggtaatgagtagacaataaacttctgaaaggtcaatgaaattcgagaaaagtttccttaaaggtaaggtagataaaaaaccacatttaccttctattttatggatgacaagataaaactcagtattacaagcaatgctgacatatttttaagacaatgaaaggccattttaccaggcaaagtagtcaacaagctttgactactttgatcactcacaaagggcaaatctacatgagctcttttagggcagttgagcaggaaaaaatggacagttactgttatctctccagattttatttcaaatggtgcatacattccttgaaggcttattccttggatctttcatttaaccccctatgcatattgaaaacatgtctcaataaatatcctcagtactatatttataaatccaaaactatttttttttactcaaaataattacatggtttttttcaacaattgtcatttgttcatttagttggtggccttcatacttcataaaatgaatgcatgattattatttatacttgatcagaaacacacttttaatactgacaaccactcccacttacagaggcctacaaatatagggtaatagtgaaaataactcaaaataatagagaaaataatttgaaattttttcaaatatatttcaaaacaaatcattttgtgaattaaaaaaatggatctttaaaaagaaagaatgctttggcacagaaaagaagaagaaaggaagatattctaaattcttttttttttgagacggagccttgttctattgctcaagctggagtgcagtggtgcaatttcagttcactgcaatctctgcctcccaggttcaagcaattctcctgtctcagcctcctgagtagctgggactgtaggcactcaccaccatacctggccaatttttgtgtttttagtagagacagagtttcaccgtgttggccaggctgacctggaactcctgacttctgcccaccttggcctcccagagtggtgggattacaggtgtgagccactgcacctgactagattctaaattcttaattctgggaaagtggtaaagtcttagctcatagaactgttctgtgaacccaactgattggactaataatgttggtagatacatatatattttttcacacgccaatacatttttcttgctttcaattaaccattaaaatatgctcaacctcattagttatgagcaaatacaaattaaatctacaatgtgactttactaccacccacaggagagctaaaattttaaatagtaaaatttccaagtgcaggcaaaaatatagaaaaactagaactatcaactgctggtgggagtataaattaatacaatctgtgtggaagtggacatatttgttaaatttgagtatgtatgtgtcaggtaaataattcaaatctagaatatacccagctaaaactcatgcatatgtgtttcagaatttatatttaagaatgatcctagaagtagtttttgagagtgtcacactgggactgtccaagtatttgtcaatagttaaaggaacatataaatgttaatatattccacaattgagtagtatatagcacctaaaatgaataaactacttctatagctatgacatggatgaatctcacagaataatattgagtggaaggaactagacacaaaagaacatgtactgtaagatttcatttgcctaaaggtttaaaacaagctaaatggatccacagtgttacaagttagaagagttatgtgttggagaggtgctactgagtgagagggaaaataaaggaggcatgtgaggcagcaggaatgtttcacctcctgatctgagttgcagttatacaccagtgtgatcactttataataatgcatcaagccaaccacttctaacttgtagagttttcttttcctattggtttaattagagtttaaataaaacatatattcatttattcagtaagtatctcctgggcacatactatattcaaagaactgtgattaggccagacacggtggctcatgcctgtaatcccagcactttgggaggcctaggcaggtggatcacgaggtcaggagatagagaccatcctggccgatgtggtgacaccctgtctctactaaaaatacaaaaaattagctgggtgtggtggtgcatgcctgtaaccccagatactcgggaggctgaggcaggagaattgcttgaacctgggaggcggagattgcagtgagccgagatcgacccactgcactccagcctgggtgacagaccaagacttcatctcaaaaaaaaaaaaaaaaaaaaaacaacgaaaacaaacaaacaaacaaaaaactgtgattaatactcggcataggagtggtgaattttaaaaaatcaatcatgtgtccaacaatatgtattaagactcggctatgtaccaggtactaaataaaaatccctgccctgatatttccttctccaagggatttttatttctcatgcaggggatacacaatagatataaaatatgcatggtaaatgttataatggataagtatatagttctgttcagtatataccaggagacaagcccttatttggtgtatcaggggttttcttcatgaaaagaaaatatatctgaactctgaaggatgaagaagaaccaaccaacaaaagagaaaggaacatttctgagcaattgtaagtattctgaggtgaggttcacagaagccatcttgagtagcatctgagtgtgtgaacagaaacatggcaggatggctccagagaggcccagattgctgagatcaagcagaaccctgttggctacattaaatactttgtagtttctccaaagagcaatagaaagccactgacaagtatggacaagggagtagcatgcaatgtttgtgtttttatatattacctttactacagaaattacaatggattagaataggggcctgcaaacatttttttgtaaagggtcagttcaaaagttttttaggctttgtgggctactagtttctgtcacatctacccactctgcttttgaagtgggaaagcagccatagaaaaagctgtaaatgaatgggtgtggctgtgtttcaattaaaattcatttgtaagaagaggtaggtgaggtttgctctgaaaacttttattcatcaacatctggattagaggaagacagaagtacatggcaacatctatcaagctaagtctgtggcctagttaagaaaagaaggtaacttgatacagggtatcagaggttggaaggtaaaaggaggaaaacaagacccctacaatggctggggataccatgagctgtcaatatatatatgagatgtctcaaaatcttattctgctatttgcaaaaaatccagtgtacactccaagatctgagcaattctaaaaaactaacattaatattgtaacttttggctctgaggccctacttgcagttattttagtttatagatcatcacatctttccaatcaatgaggtattttttctaaagtgactaaactttaagtcacccccattcagcaatttttcattaaaaatatctgcttacaaaatatttttaagtaggcagcaaatatcataggaatttatttttatgtgaaatttattacaggaacttaatttaaaattgctgttatttaatgtgtctacagtaacattatgctatgcacagcatagccctcgcttcttaaatctgttagtacattaataaacctttaaatataattttaactttaattgcatctgctttataaacttgaattttccatgatctctctaaattttaaggtgttattgtacatttgaggtgataggtatgttaattagcttgatttaatgatttctattgtatacacatcattacttaatcctatatcccataaatatatacaattataatttgtcaatttataataaagttttaaaaattaaaacagtaaaaaaagctttagtgttagtgtagtccagaggctagctttagcctaatttactcttctatgtgtactttctacatatttttcaaggatttttatttgcatttttgtgtattttattctctttatttgtctttaaatcaagtttaataaaaccatgtgctagacattttggcctataagaaagaagaaaacaaaagacatgagaaatataattcaggtttgggggacttaaaaaataagcaagaatagttgtataattaaggacttacagaatagaaaggatttctggagaacgaggcttggaaatgcctagaaaccaatgcaaccttaacgagggtcctgtaggaacattccactcagggctttgcatctgatagaaggagatcttaaccatctcttacatcttcatattagatcgcttatgatacaaagctctgagaatataacacactttttgggcttgattgcaagtctgcttcctgactgtattgagccagacagaggaagtgattttaaattacacagtagggaataacaccaagccttatcaagatcatagatgatgggagtagcattttaacccaagtgctgaagagaaggagaaggtgtcagggaaaaaaatgtctgcaggaagaaagaaaaacaaatatgtagtcaatgactgtcttgaccaatgtataatgaaattatcaagattaattggttctaatgaagccccagtttagtttgaaaagattgcaaacccttcaccattaataggtatttgagattcagaagtcatatatatgaggcatttataagtctaatgtctataactcatgtgtgttcagtgttaaggatatacagaagagaaagtggtctaattattgttagatagaagagcttcttaggggcctgatttattagagacattagaatgactggtaattagtatttcaatcgtcttaaatgccttcttttaaaatactaaaggacgtgttaaagtgcagtaagaactagatgaattggagcaatgtttaaacaaagaaacctctcggattgttttgggctttatttttaaaaacgtgagaataaatagaaagaccacccaaatgagaataatttagagcttactatagcaaggaagtcagccaccatcacttctacaagggaagagattcaagggcaagtagggaagtgtgaaagtttatagtgagaaaaagtaaaattttcagctttgagagatttcatagaatttaatgcttctgtgtaacagacaagtttcggagtactcttactaagtttctgaagtgttagtctaaggcaaacagcacttttctggtcacaaaagagtagtatcaagcgggggctcagggagaactagaaaaaaaaaacttgcttatggaattgttcatgacactaggtgccaaccaaggtcttacattttctcagtggcatatttgaatttcgttatgtttttccaggtggcttattacgatatgaagggtatcaaattaaaatttagaagtaattacagattaagtaccacattacagtgattctactttaattctaaattaaaaactctcaaatttagaatctgatcaatagattgtaataacttactctttttctgggagagaggctgcccacattccttggcaattggccatcatcccccgatatcaaaggaaataatgatgtgtcttccatagccacatccctttctgaatatcttctgcttccctcgctaacatttaaggatcctgtgaatatattgggcctaccagggtaatccaggatactccccctattttaaggtcagctgattagttcccttaattccccctgcaactgtcattatcttttgccttgtaacctaacgtattcataggtaacagggattaggatgtggacatcttggagtaggaatattattctgccaaccataccctattacattttcattttctgtggtcatatcgcagaacaggaaggagtgttttttagtcaagaatccaaggtttatagtcaggatctggaggatagagaaaatctgtgggttatttgaatacttacagctgtgtttacactgaggaagaggttgaacgaagttgggggtgtttaattaatgtagagagtgtaacacctgtatataccaggctctaacagtcaagtcaaatctaacagaaaatgaaaatgttaattatttatatttatagttagttcaccttgagtgtttaaaataggctcttggatacttttttctaccttagagaatgcgcattgatttcaatagagggtttttgtgtttttcttttgtaatataggacaatcttttttccagtgtcttttcttttcagaatatctatgagtgttcttgttaagaagggttaaaatgtgggccacatagtatagctgttcaagctgcagggttttatgtttattttaggtcctgacttttttatttgttattgttctaaagccctttcaaaatgtttttcaagtcattgtatttcaggcaaaggggatatttcttaatctaatttatatgtctgaattaatttcagatttaacttcattgacaaatagagataaaagggctgccgctatattgccaccttatttaacttctaaatcttgtgggaaagtagtttttagtctatccccaaaatctactacagtttcatgtttctgagtcaatattattaaattatggtgctgtcaatttttattagagatgatttaggtgtagtttttaggaaaatttgccctacccttcgggtctttttgacccttaagtttattgtggggaaaaaagtatcttttaggttaccttctgggacagtccaatcagattttgccctccagcatttagcagcccagtttctggccaatgtgtgtgcaagttggttttgtagtgactgggctgttaagctagctcagacaagaagccgacaggatctatgcctttgttccatggtgtgcttctccttatgacaaacaacatttttactcagcacgatgcaaaatggaagcacacagagaacaaaagggatgagaagaaatgacctgattccattacagatacctaacaaatgaaaaccaataaaaaatccagaaaccaattgagaataagtagctgagaaactcaatgcaaagagaacagagttcagacctgtggctgactttcctctttggcatggactcaccaagccaggagcagcaaggctcaagggtcctccctgggcactatgcctctggttgaaggctggggtctacagtaatgagaagtgcaaaccttgtcttggtgcagcttcagaaagaaactgcaaaaacaagcaaagactattgatataaaaacaaataaagcttatttagagtttgttatagcaagggagttggccagcattacaagacttattggcaggcaggagagtgggaaaaccttatagcaagaaaaaagtaagtcataagatacgtttggtaggaatggtaaagctgaaatggaataattagaaaacgggtatcttatgtgattggtttggggagtgtatttggctttctattgttgtttctacttgtaagtggggacaaaaagcagagagggtgaaagtgataccaggtcttatctgtttgggaaataaacctacaattgccaacctaataattaagatttaaaaatgtatggtcactatacatgactcatttgctcttcacatttggccaacaggcacactaaatgggggtttaaaaagaatcaacatccatttaccttttgcatctttaatggtgaaactttttctctgcaattcctccagaaactagatattgctttagcttgattgccttgctggaataagagtagttccagatgcttccacctcgccctttgtacctgatttttataatttcacatcctttgttctcaatcgaatcagaaaacccatttatattacaggatctctttctatcctcttaagcccatggacaatagctaccacaaaaaattgttcaatgattctgatattctcccttaccattacgtttcaaaaaaaaatctaagatagtatttccaaatcttcagagtatagtcagtagatggatgagcatatttaagccaataggcacattttaatatttccatctcccataatcttcatgtcttcccctgtaaaatacccaggaaggtctcctaatttaaccctgtttattatatgaattattgagtcaaagatttaaccggccagatgactagattataatgccactcctagaaaattgagcacaacatgatatatgtttatcctgggtgaatgcacctttgccaatatatatttatgaggtttgagccttaagttttactccaacacatactccccagtatatagctgaatatcaattgatatcatcttataactccttaaatatgtaggctatctcctttttaagaagacctgtgttactgtgtctgggctctattagtactaacatttaattatgggcctgaataaaatgagatgttgttggggatggaacctgaggagaaatggaatcagcttgtaaggttagtgccccaaaatatcatcaccaaaagcttttatgttgatgatggatgaatctttcagaccacattgggagtgacagggctgcatctaccagtaatagaatttgaggggaatttggaggatcagattttatacattatttatgtctacttatcccatatctatggatatcacttctttctcaccaatactcttaccttggcataagtggcatccttgaattaaatatttcataggattcctcttgtccagctaatcatgctttaggaatggtttcaagccctaacttccctgtgattacgaaaatttcattatgtctttgggctctcaacccatattcttgtatatttataggtagtaagttttcttttcccctatagattatctctaaagctatagtaagaagcacaatgactacacgttcttcacttccactgttgtggccactgcaactgtgtcatagcaatacaccttgtgctaagatttgtgataacttcagaaaacatgatgccacctgatcttatgcattagccagatccccttagcaaacaggtcattctcatgtttctccaatacataagcaacaaaattcaatgatcttattttgataatctgttttctgtggccactttaatatcaactaacgtatcagtaagggtcccagtaggaacagatggtgctctcaaattaaggtaattacatttattaaaggaactttaacaaatatataggaaggatttaggtaaaacacaaactaaagtctaacatgccaggacttgtaaagcagagatacttagtatcccttgcctgaaagaatgagggagaggaaagagtcttgaaaagtggaaggagcgagatatatggagatagcttggagagcagtgactttcagtcaggagacacagtcaataagaggcaatggcacagagagatggttgagagaattaaaataatgacatcattctcctcattgtctgtggtttcctgttatcaaatagaaactaaaagaaagaatgaaagttcactacctggctcacagaatggattggaagaaggtggatataaatttgaaagggcaattggaaggcaatctaaacacagagtttataaaatacattttaggtagacttataaattctaaatgacattttaaaataaaccaacaatattcactcacatggccacgtctagcttcaaagaaaactaatgattatatgttcttttatctaagtagtaatttgactccttaaatatctaaaaactccctctttctcttcatcttactctttctttcccttcccttgaaatgcaaggatttgtggtaatgtcacgctagggcagagaatatggtcaagatagagaggaagcctacatcagaccagaaaaagtggttaggggctgaggagggagagaggacatgcagggctgaagtgatcagaattgagagggcagctgaggcttacgaggccagcaggcctaatggggccaaagtggagggatttgggttgaggagataggaggtgtttggagccagtgggcatggtgttgaggaggttgtcaggactgtggaggtagcttgtgtgatcaggagtttgattacataagggagtatgagcacttaagtacatatagtgagagtaatgggatgaaagtttctcatcaccagggaatgaggtaaaaatatgagatggaaaacagctagaatgaaccctcttgagttcagttggaattagacgtatttgtataaatacatggtttgggatatctatacagatatattaatggatcaatagatacaggtagaggcacatatatacacaaagagatatatggcaaatgaataaaaaataaattaagaaaaagcttttcattgcagtaggatgccaactcataaatttagaatgaatgaggaaattagaaaatcaccatttagtagccatcataggaataatcagctcatgagaatcatcaagggatgccaatactagtgggcagaattatctcccccaagttacgtattaattacaaaggaggttgcaataaatttataatggagaaacctgtgagaaactacctttactacatgattaaagctaataacagccatgaggaaaatagaaattatgtgccccttgatgccatccaatgagaaaaccaaagcattgtgtctgtgatatcatagccaaaaatatacaacctgaatccaatgataagaaaacatcagaaaaaccgaatttgagtgcattctgtgaaagagctaatctgtgtttttataagtcagtattaaataaaggaaaaataggaactatttcatattaaagggtattaaacaggaacagcaccatatgtagtaagtgaatctaaatcagatcctggaccagaaggaaaaaatacgttttaaaggcattgctgacttgtttaagagtaatgggatatcatcccccatatagacaaaatttaaaaatcattaagagccatatatatacacatatgtacacacaggtacttatacctacatgcatatataagtggagggaggaggaaagtgggagataaagagagaatgtggtaaaatactagcactggggaaatttgaattaatgccgttgggagggagctggaactcctctttggggcctgtggaaccccgtatccccagattttttttaaaaaaattgagttccttcaagggaaattccaggcacctcgctagccttaaaaagtcaatgagcaacttgctaagcaagaaggtgataataacttaaaaccgtagccagggaagttagccacaagaatgtttagttcccctgaagaaactaaagattacatcttgacattatatggaagttctgtgctccattcttgaaaagtttttgtaagtcatgtcaaaatgaatgattggaagaaagaagacatttacttgttgagaagtgagaggcaagtagcaatctctgtaacccttacatctcaatgatagatgcctatcagttcctgggcttccttaatgtgttcatttttttctgtttttctttcctagctacaatgtcatattgtgtcttagtatgactttaaataacttttagagaattaaggaaaaatgatgacagcagaaagatttaaatccctctggactatcacacaaaaccaggccaaagaacaaatgggaaaaccaaaaactcaagcaaccaccatatattgcatcatctgtaacaattatgaaataaaccacctcttacctttcagagtgctaatgggggtcctttgctgaaggcaatggaaactctgatttcaacaggaagacttcatgagtatagggaagcttagggaatagcctgcagagacagagaaccagcaaggagacatatgaaagaacatgatccaccatcttaagaatccattctgctgaaaaatcattgctgcttagtctcagtggtgctagaaaacagatactaagaactcaatcacagtggtcttagaaaaaccaaatacttctatcattatgcttctagaagcttctgatttccatctcccagtcactgcctcagattgctcgtgtatttatctaagccttactttggtgttcccattttgtaaaacgtaatctcacatagtgcaccacctgcaagggagcaaagaaagtgtatatttgctttctcaattcaatagtacaggaaagaaagctagaaatggtttgaatgagtgtgaagcaagggtatctataatatctgtcataatttgatctaaataaaaaatggagtctgagcatggtgcctcatgtctgaaacctcaacacttttggaggctgaggaggggggattgcttgagttcaagaccagcttaggaatcatagggagacctcgtatctactaaaataaagtaacataaaataaaaaaataaatctaaagggatcaaagacttcctttttgaaactgacattatcgtagtctctcttctgtttggataatacaaatataaatgaacatgaagtcgtatagttttattgaggaaaggaaacacaaagattaccaatccaaactgtataattttttaacaacatacagaaacagaaacccaaacaagatcaataatatttcagtgctacccacttacacgtggcaagctagctagaataagccttactaagaatcttactaagatttcctatctgaatgccacaaaagactgaatctaaacttgtaagatgatatttttaccttcatgtcaaaaatggaggaatctttttctttttctctgagttttcacacttaacattgtgtatttaaataattaagtagcatgaaaaattctgtttctatcaatcactgtgaaagttgtcatggtacagtgaattttagaaatatgtgaatagtcttccttgagattgctcccggcacgggtacgccccctgccgactgggagagtgcaccacttccacaggcaacattttattttctgctgcttctccctaggcttatcatgaatagctcttggagtctgagactttcaaagtcagccctgtaagatctacgctagtgccaggaagtagtgttctaggagccagtgccatcacagaagacaagatatgatcactttgcttaatttatctcttattgtctgtggcaattaatgatttctcaaaatatatttttctttctttttgttttgttagtattttggcagagataagaaaatatacgtcctttcaaactgccaattatattttatctttccacttggttgtctgatcctgtagcaacgaggtcataacccattttaaaattaaacgttggatcttgacctgaattttactactagaagaaactttaaatttatcactttttgttccatggctttttgttgatttcttttttgagtgagttgccacaaagcaggtgtaacagcaagtggtcagtccactcagcatataggtttagtcatagtcaaagaagatgagaagcattgtattagattttgacattaaatattcccagaaggacagttcacattttcctgtctgaagaggtattacttatgagtgcttcaatttttattgtaatccttgatgcagctcaaatcaacagaaggatagctttaggaatgaaagatggagtttgcactagcattgtctgatattcactcaacctcagattgacagtaatagattgttactagggtgtgcagagttcactgcaaagaattatatgtcttttctgtccttggctgtgaagttaggctacgtccacagaatttaactttttattagttttcagaacatcactttaaaactatgttaaactataatacaagatctggaatattatccttgccttttattaaattttccagtttacaaggtaaataagaaatcattgaaattaaattcaaatagttaaaggttttctaattttggtaaagaaaaaaattgtaacagctcactgcattgtgctacaaagagtagaacaagggcaaactgaatacagttccctaatcgcaattctgtacatttaacaatcaaatgtattaatttgctttagtatacttattctttatgcacagctgcaagcatatatttttatggattcaataaatgaaaaagaatacaagcagtattgtaatgaaaaatatttatttatatagtgttatttaaatgataaaacatcaagttattgcatttaaagtattgaaattctagtccttggcaggttgtttagctatatattatttagatttttatttgtttatttgtaatataaaagtggttaacctagattgatatttattgtgtttttgtttttgaaattataaatattgtcattttacatatgtgaattacagtaaaatatattaaattatgaatataatcaatttcatccactgccttgaactccctagagaataaactgaacaatattataaagcgtttttgcataaattctaaagagttccaaattataaatcacttttattcccaaaagtatcattttaatgcaatttattaaataataacagaatctaagttgagtaataatgtcccctactcatttatgtcacattttaattttaaaaagctggcaaactatattatcattagtgtacaagtctctaggtcatggactatggcaaattcataaatatgtttgtaattctgttttagctttttaaagattgattagaatgccacacaacaacatctaagtgtcgttaatattttcaaaaagtatatattaaagaattatttaccaagcctcctgtatgtgtatatatgtatgtacatatacacttacatacgtatatatgtgtgtaataaaaatatagtgatatttattaatatttgagaatgttgacttccaaaccactaaataaaactagcaaagtataatttttctcagtattattgagtatcaccaaatggcattttgggaatttttatgggtttctaaaaatatctcattctatgttacctgtaaaattttacttttgagttcactatagtttgagtgttattagaaagtagaggaagtgtcctcaccgtgcactttacattgaaatggattggggaaaatatgaaacctgaaaaaaaaatggacttccatgtgataaaaagaaactcttgatttgcatcacatatcaacagcacctattgtttggaaagcaaaagtgcacattccaaaatgtcaagaagcagaacaagtcaaggatggaaaacataggaaaaaggcagagggttactagcttcagagaactaggttaaatgtgatggaagagcaaatgctagtaacactgtcgaaaagagcaaagcacagaagttttagatgatagtgtcaaaaatgtgaccttagcaatttcaaaaagagataatataaaagggtattcctagaaatgcctcaagtggcctcagcctgcaaggcaggagaaggaccatcactaccgcctacacaatgaagttccacgagacaaagaaattaaaagagaaatggcaggactggacagtgcacagaaatcctaaaggaaacagaagtaacttatggaagcaatatttacgactcaccactaaacccgtagcgtctcttccaaaaacaatgccagacgcggtggctcatgcctgcaatcctagcactttgggaagccgaagtgggcggattctgtgagctcaggagtttgagaccagcctgggcaacacggtgaaacgccgtctctactaaaatacaa

(The sequence listing continues in the following parts.)

What is claimed is:

1. A method of treating a human subject afflicted with a cancer that is determined to be responsive to trastuzumab therapy, comprising
    a) obtaining a biological sample that comprises cancer cells of the subject;
    b) determining whether a copy number of a human chromosome region beginning at 4q169.81 and ending at 4q185.239 as defined by reference to the freeze HG18 reference genome (SEQ ID NO:1) in the cancer cells is amplified, wherein determining the copy number is performed by contacting DNA extracted from the cancer cells with probes or primers so as to amplify the DNA, and determining if the copy number at region corresponding to reference region 4q169.81-q185.239 (SEQ ID NO:1) is amplified in the cancer cells compared to the copy number of region 4q169.81-q185.239 (SEQ ID NO:1) in a diploid reference;
    c) diagnosing the human subject to be afflicted with a cancer that is responsive to trastuzumab therapy if the human chromosome region corresponding to reference region 4q169.81-q185.239 (SEQ ID NO:1) in the cancer cells is amplified; and
    d) administering to the human subject diagnosed to be afflicted with a cancer that is responsive to trastuzumab therapy an amount of trastuzumab effective to treat the human subject.

2. The method of claim 1, wherein the subject is afflicted with a cancer, wherein the cells of the cancer overexpress HER2.

3. The method claim 1, wherein trastuzumab therapy is administered as a monotherapy.

4. The method of claim 1, wherein trastuzumab therapy is administered as an adjuvant therapy.

* * * * *

UNITED STATES PATENT AND TRADEMARK OFFICE
CERTIFICATE OF CORRECTION

| | |
|---|---|
| PATENT NO. | : 9,677,139 B2 |
| APPLICATION NO. | : 13/491359 |
| DATED | : June 13, 2017 |
| INVENTOR(S) | : James Hicks et al. |

It is certified that error appears in the above-identified patent and that said Letters Patent is hereby corrected as shown below:

In the Specification

At Column 1, Line 17 insert:
--This invention was made with government support under grant W81XWH-09-1-0591 awarded by Army Medical Research Materiel Command. The government has certain rights in the invention.--

Signed and Sealed this
Eighth Day of August, 2017

Joseph Matal
*Performing the Functions and Duties of the*
*Under Secretary of Commerce for Intellectual Property and*
*Director of the United States Patent and Trademark Office*